United States Patent 11,549,145 (METHODS AND COMPOSITIONS FOR INHIBITING AND TREATING NEUROLOGICAL CONDITIONS) - sequence listing, part 116

SEQ ID NO: 2089 - DNA, 212781 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctg

SEQ ID NO: 2090 - DNA, 180410 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaa

SEQ ID NO: 2091 - DNA, 195044 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaa

SEQ ID NO: 2092 - DNA, 216832 bp, Homo sapiens
cgaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaact

SEQ ID NO: 2093 - DNA, 216832 bp, Homo sapiens; identical to SEQ ID NO: 2092

SEQ ID NO: 2094 - DNA, 180410 bp, Homo sapiens; identical to SEQ ID NO: 2090

SEQ ID NO: 2095 - DNA, 216832 bp, Homo sapiens; identical to SEQ ID NO: 2092

SEQ ID NO: 2096 - DNA, 180410 bp, Homo sapiens; identical to SEQ ID NO: 2090

SEQ ID NO: 2097 - DNA, 216832 bp, Homo sapiens; identical to SEQ ID NO: 2092

SEQ ID NO: 2098 - DNA, 195044 bp, Homo sapiens; identical to SEQ ID NO: 2091

SEQ ID NO: 2099 - DNA, 216832 bp, Homo sapiens; identical to SEQ ID NO: 2092

SEQ ID NO: 2100 - DNA, 1111867 bp, Homo sapiens
ggggcgaaggtgaagaccggctcctaggatgagtgaaggggcggccgctgcctcgccacctggtgccgcttcggcagccgccgcctcggccgaggagggcaccgcggcggctgcggcggcggcagcggcgggcgggggcccggacggcggcggcgaaggggcggccgagcccccccgggagttacgctgtagcgactgcatcgtgtggaaccggcagcagacgtggctgtgcgtggtacctctgttcatcggcttcatcggcctggggctcagcctcatgcttctcaaatggatcgtggtgggctccgtcaaggagtacgtgcccaccgacctagtggactccaaggggatgggccaggaccccttcttcctctccaagcccagctctttccccaaggccatggagaccaccaccactaccacttccaccacgtcccccgccaccccctccgccgggggtgccgcctcctccaggacgcccaaccggattagcactcgcctgaccaccatcacgcgggcgcccactcgcttccccgggcaccgggtgcccatccgggccagcccgcgctccaccacagcacggaacactgcggcccctgcgacggtcccgtccaccacggccccgttcttcagtagcagcacgctgggctcccgacccccggtgccaggaactccaagtacccaggcaatgccctcctggcctactgcggcatacgctacctcctcctaccttcacgattctactccctcctggaccctgtctccctttcaggatgctgcctcctcttcttcctcttcttcctcctccgctaccaccaccacaccagaaactagcaccagccccaaatttcgtaagtaaacactgtgtctcaactatgatttactactgagtttcccttctgccctcctgctgtctttttccctcgccgcctgttttctagcaagccccctcccccatcccaggtttggggcagagtgagagctgattaaaactggccaccagcggggaagaaggtgccagcctgctctggttctgggggggtgggggcgtgtaggaacgggagggagattgtcaggctccactggccccactttagcgggtcccaagtgagaacagatctcccaactcccttcaaagggttaacgcgagtgcgatccctcctcactgcagacctgctggcgagctgccggatcccgctccagtagagggccagggagggagagagggccttcccgaaggcactgagccccttctccgcccgccggtaggaaggaaagaaagcaaagcacatgcaaattgaccgacgataaaccacaaaaggaagttatgtccttgtgtggggtgacgagttgatggagataatggtagaatgttgctgaggacgcttccagcagccctgacctgggcaggaaccagaaagggttaattagaagccactgggagacttggggaaaggaggcgatccaaggcaaagggctaaactgacctcctagcctgcctgtggccattccaaggtgtagacatagattctgtgaccgccgagagtgagttaactaggaggaaatatgaagggagccctgcagagctgccacctctagggtcctgacgaaggaggagtttttttcagccctgccaagcctttgcttttgttccgttcccaaaggtggggtgtgaaccttatctcctctccctctgtgcctgaaaaatatagacgagttgagagttttctgcactcaagggtgagaacatccaaccgtttggaaacatgtcaccgttagaatgtagcatcttcaacctgggctcagtatgagccagtatacccaaagcatgatagctttctgtttatttgtatagaaagtgcgtattttctcaacatttttataaatgttgtaggtgactaattgacctcccaccccaacccccaccttgttcttattcaaaggaaatctcaggtgtcttttaagctgatctgatcaggatatgggaacagtttgtgcaacctgtgaaggttatttaggacaaaccccaggctgctagttcaagttctgtgcaaggctattttgcaaaaaactgtctggttatgctgtctttatattgtatttgtgttttgagccatagcatctgagataaaggaagagtgttcatcattaactcttcagtgatgatgggaatactgggtttgctttcagtcatctgctaatttttcatttccctgccctatgatcttaccctgggtgttacttaacccttgaaacttttttctttttaaagaatgtagtgtatttgtaagtaaggtccaggagagggaaagggggaaaaaaaagcaaacctactttgctttggaaaaaaccgtctagaagataaattgggagacaggaaggagggaaggaaggaatctgccacaaaccagaatggcagtagagccagtaacttgctgcttctctctcctttggctgaagcagtcatttttgagagcacattttcccaggaggtgtttagagcctccactcaacaaatctagcttgtgttttgtagaaggataaaggattcatgagtgtatgtgtgaacatattcaatggattgaaaatgagtctaccctgaagaccccagatttttgatctgctcttttgatgcagttgatagaataatggagtgtggtatacctccaacccttgtatgcgttgggagaggagggggactacacacggtaggggtatttcatgttctttctcaattgatttccttgtgtaccattccggaggtctttaaagaaaagcccaaggtaattatttctacccctctatgctctcttcctacattccgtggacgggaatggcagcctgtttaataagtaatgattattgacagggccctcagccccaaggaaaagaggggaaaaatctgtaaatggtgtcaatgttcacatagacatataagcagtatttgttgtatttgtatcttagtttcagctctttctcttttttaaacctttacaagaagttgaattaaggtatgtaatacaagtatgcaaaatccagctgaaattgacctggtttgcatctataaacaagggaaattttaaggaaaagtggattatgtagttttcataaaacgtgtttaaataggcaagttgtatggtgacttgaagaaagaggatagtttagttatttttttcatccaagattgcaggatgattaacaaaaggaaattaagatttcatttgagagattatcagcagtgctactgtaggatgaaaaaagcctgaatcactggtgttcatattttttttacttgtcttgattatgcccgtaaagttcccaggagagaaattttcttttccccagctcctacctccatactttagtgggtctttccgtcctttcttttttttaaatgaaagtaatggattctgttgtagtacttgaaaaaaggttaaggatgatgctttcgttttttgactaacccacaaattctttaatggccaggatctttgctcttgcattggatacctgaaggcttatggaatgaatgtctttgtgttcatcttagatcaatcagaaggatcctgtctgtaaggatcctgtctctttggagtggaagaggctggttcactgacaatgaacatgcttgctaatggataataggattttttcaagcaaaagctgtttttgctatgggaaaggcccagttagagaactgtttctaattttctgtaggaataaagacaaagaaggattgaactttaaaggcaggaggagaaaggagggtttgcaagttgattcttctcttcccgtcctccaccgtttaggccgtgagctggaccaaaactttcttcagcgttcctgggattcttgggtttccacttgcctagtacttgcttgcacttcagactctaaaaacgaatgtcttaaacatatcgccaggggagattatttcaccagaaacatctttgaagcattttgtatttgaaagtagaggttaatttacaagtttttcaagccaaagggaggaggtcactacagacagtagaaaacagtgattttgaccaatgtacaatcagcctttcccttttacagcgccttcaatttcgttttcagatttgaaatatagttgtacaatgctgccaatgcaaatgtggattgttttagagacatagaattcttttactaagctgaaaatactgtttaacaggtggtagcccggagtcattggctaaattcaaatactaaagacaaagagcctctttttataggtgtttctttgggttagatttggaaggtatatggttaattataatgaacatcacaaatatctaatagtgtatttaagaagaaataaatgtagaatgtacatttgatgtttaagcaaggtatggaggcaattttaatttaatcatgtctatttctataaaactttacctagtcatacctactgtaatttttaagagaggcattgataaaatcaagtattttcttatttattcttttcaacatcttcattccttaaataagggtacacttgtttgctttataagcagcctcagatataatttgtttaaataaagttacttctgtacattgtattctctctacatgagtcgaggcctttaaaggcatccaacgtagaaggtactgaccccaatcatgcatggtagccaaagtgagaggattcagagctcaggatcaatatttcttatgaaatccaattgagagcttttttttatgagcacaggctgcaacctgagtatgttttgatttcctttggccttaattcaggattatgagacttttctgctttaatcaattatgctgtacaattttactgttacacacttatgttgcacttcatggtcctaattaaaaaaagagggcaggggtgggtgtgttggcaaggatatttttagggccctttttagtttggactcgttggtctccgtgcattaagacaatgcggtttaagcattcctccccagttcttcagactgaagtgagggataggaggtgttgttaattgagagtcccttctgcaggattaatttgtgaatccagctacagttatatttgtgctattttcaaaacctgaccaaaaaaaacaaaaaaaaacccagctggtttctggcaatttctcgctgttactgaagcttttctaaattcaggttgggcaacaacaggagtgttggtgcagtttgaaatcagtgccttcctgggagatccaggatgtagaggaataccatctctcctctctctggagctactttctcagcccttcctcccctttgtacacaatgagaagaaagcttattttcaacttgcttttgtagaaattctttcctcataacctctcatctccaatgccaaacatatctcaatattctatctgggatgtcaaaaatggaacatgaaagttggccctgaagtatataagagcaagggaatagtcataaatctaagtctgtaaaatgcatttgaattgcttctgaatagaactgaaattcatttttctttctttctagctgtttttatctttagactcgtgtgttgggtaaggacagagctggtactgcgttgacaaatacattttgagatcctagaaattttacttatccacccaagaaagtgttccctccagaaccatatacataatgaagtgagcaatggactctatttgaaactttgcaatatcacaatcaaaacttacctacataaatgtttcctcttcatgcaattataaataaaatcattagacacatgtttagtttggttttccatttcactcttcccctaagacttcctgtactcccacctgccagtattttatagttgaatcatggctctgactgaaggctcctttcaggcttttgtgttttttttgtgttttttttttttgtttttttgcccttttttccttagcctagagtacaaggagtcaatactcattaaatgaaatttcttagatatgcttaacgtcttgcttcaagttgttttataagttaatcttttgggtaagttagagtgcttaagttgatgtagaaagttaaggaaaaaaatactcctttagggaactgagttattaaactgtcttggtgatttaaaacaataattaaggattcttaaaacctgatggaagctaatggtcatttcttttcccccatagattggtatacaaatcatattaattttggtagcatttttatctgattccacaacacagttgagcaattgaacataagctatcatatacattcatataattatattttcataatatatgtcacatgtttcaaatgtttactaagtatctatctgggggcattgcaatgctgttaagtaattggttgactccgaaagtttgtaaaagtaatggttcataaagcagacaattaaaataaaacttttaatcactacaacattcagcctcccatgtcttgatgttagggcgaaggctttttctaagtatgtgtctactggtttaagcttagcatctttgcttttcttttttttttaattagccacacctgtaactatcagctttttttttcttttaaaagacactagcgaaggaatccgtatgcagattctttataaatacaataataaacccttgccctgggaatctcttgcagttttcttgtctatatgattcagtttctttttttatgctttaaaaaacaacttaccttttggagtttcttcaaagcattcaactacattttaatagaaactacaattatctttcatttccataatcatatatcactggtttacataatatttaagtaaattacataattagcataagaacaactgacgtaaacaaatctattatcccaactgagtactgtaaagtgcacaactcagctggcagttgcagcagagtgtaggtttccttgagcttggcctggtggctgtgtccctttcactgtgcagtgggcctctttggtgtgttcctgccaggcagtgtggtggcagccagttggctaagaggagttagattaaggaagtgattcctttaggaggtaacagtattagaaatgagagtcagtcataaccatattttttagggactctcatggaagggtaacaaatatatgtgtgtgtgtgtgtctgtgtatgatacatatatatatttataaacaatatttgtttgtatatttctatataaaacctctagccgtgaattctataatagctgtgcaacctttaggaactgatacaatctctctgaagtttaacttcctcccctggtataatgaggttgatgacaataacctgacttctatgccaatcccgaaagagtttataagctgaaaaacaatcactgtttttatgtcaagtgaaatgggaagtagatagactggttattttcatccaagagcacatcagactattgaattcggttgaaatattggagctggtttgttacctagcttgagggatctttcatcacaatgaaagattattgttcttatatgcccttgggtttttcttatattcctctctgatatcctggcacacacaataaaatatagtgtggagtcctacctcaaatcaccttggaagttgaaccacaaactggaggtcatcatttctcattctttgcttggaaggtgttttttaaagcctatttccagcatatgtttatcaaagagaggagctgaaatttgggagaaaatgagtgagattcctgaatgatctggaaatctgaaatctaaacattcttgataaagcaaaatatgtcctaggtgcccttttgtgccatccctacactaattgtcattgggtctttagattttggagagaatttgtgtgaaaataggcatgtctgcactgcattcccttggccacttagcagttactgtgaattagattctcaagaattaataggttgattgtatccatcaaggagctcttttaaagatactgtttggatttgtactttggggaactttaatattagcattttggaaatatatttcttcaaatctgtgtttgttggaaatctcatcctgaattatatcttaaagtattactttttgttgttataagcttttatttctcaagacaggttggtgattgtacataaatcatagattgccattcctgggcctaaaaagggatcagtcagaagcaaacctacaaactgaattcagaattaagtttaataatggaagtttagcagcttccagtgctaagattttgtctttgaggccttttcctggaagtgatagtgtgtatcatggatgcaatataggccatacgaacatttttttaaagaaaaggtcagctgaatccatgcaactactttagcattagtatgttacagccagggttatgggaatagaatttttatgctaaacgtttgataagaattcttaaatatatcagccttcctcctcagataccttcctatgactacatgcaacctctggcatgatttcctgtgaattgccagggagctagaaatccactaaaagagaaagccacaccctcatcatcatcagattttcttcatttttgtagcttgaattttacttttagtaatgtagaaggattagtcacagataatcagtcttggaaggggcttaagaatttaagtaataataaaaacgacagctgccatatgtggagggttaccgtgtgcctgggcatgtagcactgtacattcttcgtgttatttatttttgaaataaggattgaaaaacaatcatatctaggcctgcagcctaggtttgattatctcactgatagagttaatcaagctgggcttaggatatataatttgcctaggacttgcagaaattgtttggataatcaagaagactggaggagtgttttacaggtaatctctccccacctcagtcttacttacctaattcactgttatagtgtcactatatccatttgtacattgcttctgtcaagcacttcacacacagatagtggcatttgccactgtaaactccataaatagctcacctgcactgtacctgttctttgctctgatatggaggaatctaactagagaaattgcctgggttttctgtctaaggagaaattcagatgtttcggtaaaagataaagaatatgttgttctgaatgttgtcttcttgtttattttttaagttttgttgatatgtaattgatatgcaatgtgctctccatacacatccttgggttctgcatctgtggatttaagcaaccagggatcaaaaatatatttaaaaataaaaacaacaacacaacaattaaaaatacaaataagaaacaagtatagtataacaactatttacatagcatttacactgcttgtaagttctctagtgatgactgaaactatatgggaggctatccttaggttatatgcaaataccaggccattttatgtaaaagacatgggcatcctaggattttgatatcctgggggagaggaatcctggaactattcccccctggaataccaaaggatgactgtacaaaaaattgtacatatttaatgtgtacatatcgatgagtttggacatgcatatacctattaatgctgtcaccacagtcagggtactaaacatatccatcacctccaaaaatttccttgtgttctcttgtggttttaattttgtttaggtagaacatttaacatgaaatctatcttcttttttaagtatgcagtattatattgttaactaagtactatgttgtacaacggatctctagaacttattcctcttgcataactaaatctttgtacccattgagcaacagttccctacctctaaacttctgttccttgatctttttaactctctattttctcttatggctgcttgtaggtgattcaatgtaacaatgacagaaaacagttacagactttattcctctgcttcctaaaatccagtcaaaattgccttctctgcccattccaagcttacttttggttacaatagtgactgcagtgtatgctgagactgatcaatggaaaagtgtcagggaacatttggaatgatagccttttagttctgtagacactaaagtactgactctaccaaatcaatgatgggagttggagctgcatgcaatgcctgctgcagaacatctgaattccatcttggagccacactgcgaagtacccatcactgattatctaccagttctaagaaggggaacattggtgagaccttgatattctgccgggggtactacaaactagacccaatcattgcttacttgcttgacatttttgtttgccaagtgttcttttagctagaagaaaaaaattctcttttggttaaagtaaaagatagttgagattgttacttttacaaacttataaaaataaaatggaaatagatcaagttctaagatcacgtgacactcatttgaatagccatgctgaaggataggaatactgtagtgtcagaaagattgtattgtcaacatcctgtaagactgtaaatgaatcccataaactaacaatgacagttgtgctcattgttagtctatgaggggggccactggggttgtttgcccaaatttattgttagaccaaagcttttttcagcatggtggaaaaatctagagacaccagaattttttaaaaaatgggctgtagaaatgtttatattaaatgatagcttgactgaattctatttcattgacttttcagtatgatactctctgtttctggattaaaaaactaacacatttcgggtgtgggggaggtagagcatcaggataaatagctaatgcacgcggggcttaatacataggtgatgggttgataggtgcagcaaaccaccatggcacacgtttacctatgtaacaaatctgtacgtcctgcacatgtatcccagaacttaaataaaattaaaaaacaaaaacaaaaacttctgacaaatgcccactccatgccgagcaggtacagttggtagcacttctgtcttaaccaaatgaaagctgccttggttaacaggtattagttatattagctcccaaacctgtttatgctgattgtttttgttactgtaattgggtaatgcatttaagtattctataaatctgtgaattgtggtttctattaaaacgaagttcattacattggatataatccataaacataagtcactttaaaaaaagtgcttcttctacttgacaaagttgtgagaagtttaacgagaatatatttatatatccataagaaatttgcacttgtattgtttcacatgttaagattttattccacaataaactaaactggaaaaatcacattatacattatgggtatggtttttcataagaaggacaacagatgtttactcagagaaaagccttgagctctataaccaaatatttggcaagtgaatgtgcatttgtatgttttaagttaaaataataagtaaaataaattttgtttacccatgtgatagatattacaaagctattaaattttgttgtactaattttaaagctttcgggaaatgtttggtatataatttttatctaaaactttgggtagaaaattatataagatatccatgatattaagctttactggtcactagatttaatatatagtaactgtattcaaaggaagtataccaaattgttcatggtagttctttctggattttggaatagggatgctgtttaatttattgtacttttttgtattatctaagttttagttattgttcatgaattatctttttttctaattagaagttgttatacttttgaaaaatgtaaagaatatactccatgaatcagttcaattattggtcttggttctgtgaagattgttttttctttatgtctaaagagtttgtttcttaattggtggtgtcagcattaaaatgttgatggagttgggttgctgctgtgaaatgcagatgtgtagaagtgcaaatgcatttccatttgctcatgggaaataatgccttattgaaggcagagtttcttactctgggcctttgatgattagccttgactttataagggtatagaagatgggagtttaatgagatacttaatggctcttccagtctgcagatgttagacagtcttagtagtattgctatacaaggatatagccaacagaaatcaataagttatatacacatattaatcaactatctgatctattccaaggatcaaatgaaaagagaacacaaaggctaattgacagtgctgagtactagaaaggagatgtttggtcaaacatgaatgggtgggataaccagttcaaaggtttactggatgctataagcctctcccagaatcataagatatttattcttatattaattttcagtggctggaacatagacagactccagagtccataggagagtggtgatttgtagggcacatgacccataagtttggtgatgagttgtgctcaaagtccttcaaatagttcacaaatgcaatgttggtccaaaagagccagaacaaatatatgattctatttatatactgtgtaacaattagaagtcaagatggtgattatctttggggaggaggggcaggtagtgaatggaaggggacccaggtgtaggttttcctgtattgataatattgtgctgcttgatatgggtgctggttacatgagtgagttcacttcatcaaaatttagtaacttctatacttttgatttgtgcactttttgtatacatcaatactaacttgaaaaaataagagaaaacttcaggaacattcctttggcctttaccacttcatgcaaccagggtggtggcctgagtttataggtttttccatgtacagagactggatggtagctctgaaagtttgttgttggtgtctcacagtccagcagatgcaaagagggtcttcctggcttcagcattttcctttgttctcaggatcccctcttagtgagacttcatgcaaacacccacattcccttttgacgtaagcctttctgagtggacaccttgtatttatattcaataaaaccctatttcactcatatcaggagtgttcctgatataacacattgcgacacttttcacatatcttaacacatgtaaaaccccacttgtatcctgagaatggcattattacagttctgcaaacattaaagtgtgatatacacaagaaagataattcatcatctgcatctgtggtttttgttgagaagatcagaagatatgcaccaaagaatcattaagtgctgaaatgtgtgattccaaatgaaaagcatatgaggccatttcagaaagtagtgcttagagggagaaaggtagtttcaagggagaatttccttaggcagagtaatagagaagggaggcccagggagggaaaggtcattaataaaggtagaagtttgcatgtacccacctatatgggagccagtgagggttctgacctggtagacagacggcctcaccttttccttggagcagcgcctgattaaggagggagggttttggaggacacagcttgattctatgttaagccacagtcagaatgggttgcaaggaagtgatacaatatctgtggtattttcagaaggtgcgaggtttccaggatgacttggagagaggaatgagcagcgaattttaaagattctctaaggctaacttgttccaaatcatttaaagatattgtctctgatttgtgctggatatatttaagtattgacttcattccaatgcctcttcaaagcgctgcaagaagcaatagaattggcatgttttaaggatgtttagtttatccatagtcgcatcaacaaagccctagatttaacccaaaataacagctttcaaatacctaaaaatttgcaagtagagatacaagaagaataacaagaaggaactcttgatttcactgcctcacctaaattaacctcttactgtctttaggtttttcagaggcaaaaactcctttatgaattgattgccacatcacccttctggttccatctgaggtcttctttgcagaagccactcagcaccttttggaattgaatgctgacatcgcatcagattcaaaaggaatgctgctgttgattcctttctgtactcatcacatggtgaggaatatgctgggagtctgtataagatgaggctcttgcacggcctgccagagagtgcctgtcatggactggagaactgcatccgttcatttacatatcggcagctaaaattagtggagtcacccacgtttttcaccctaaagaagaaccttcagataagaatccagttcatcactctcgcctgctcaggcttacttggttgctccttgttaccagacagaggggctatagcgctgtgtaagagcaaatgttaaattagtattaatagccaatggcatctctcttctatttttcactgatcaggtaattttcactgatgtcaacatttataatacatcagctgacatatacaagtgttatttgcttggaatatttttagtttatctattttattgacttagataaagatatattttttaaagttatttgttcaggtctttttgtatttgatcagaagaggtttttgaaaggaaggcgaagctgtagatcagggttttaacaaaatgagcatcaaatccaaatctgtgtttctccttcatcactgagttttgtaagcttctaaatgaccttttgtggtaccacactgatgctcatcttgcattgtgagaggctctgagtaatttatgataaataatgaaatgctgtttcctccaatacactgcaaatggctgagtcttgtaaaagtctaaggagctctattacttctaaatgactagataacacaaaaatgttaaccctaaagagaaaaggtcaagtagaccacgtgcttgtgagccacagtccttctgcctggtgccttctgacaggctttctgcatctgaactctgcagggactggcacctgaaacattactttctagaatggcaaggaagggtttaagcctttcggctacttggattggctagaagcaatagtggtttgtttggagtggggaagggagaaacttgccgaatccatttaacatttgaaaccctaaattaatttttaaaaaaaatctgttaccagtggtaagaattttgtgatgctaggaaacaacaatttaagtattttatttgagcactgatataaaaagaaatattaaaaagcaagcagagtaatgttaatctgtaggaaactatagaaagctgacatcttttcaaaattaacctttgccatgatgtttgcactctcttgctcatatccacgtatacaaaaataaatacatagtgaacatattcagtctacaactctcagctccctggtattccacagtgtattcctaccattggaaaatactgtccacagtgaatatgtgtgttctcatcctgattgctgtaaaataactgcatatctaagtgttagggtttgaagactttaattgctagctacagagtgtctttatgtattgcacttccattttgaaaattgaattaaattgccggtcagtgaactctttataatgacaggagagtgtctatgcaagcaagccattgagcagagtgatctttggccagtgatacttttaaactcagacactttgctgaagtttgccactgaattttctcacatttccccagatgttattacattgccaaatgaaatcatctgttccccctagtagaactgcctcctttcctccagatatcagctacaaggtatgaaatgaattgcataaaaataaatcacacatgctgcattttgggaagagtactcttgctgatccattaatttcttttcactgctgagttgggaagtccactttaatcttcaattatcagtaacgtgcaattggatgaacctcttgacctttccaaaatagagatgctttcatgccaggaaatttgagctctttgaacatttgagaatatttttgcttttgatgaaaaaggtttgttgtcatgtgccgtgggagaaagagattgaaagaaggaaggttattcccaaaggcctgtttgatgattggactatatggctctattcctgaccatgtactctctgtaaggtttggcatggacagcaatgtgctgttggcaatatggcgcactttaaggtatttaagcatggactcaggagtttgtagattatccaggcttgttacctcatctccatatgcctagtctaccacttccacttagatgctctgccatgttgcaaactgaacagaagaccctgatgaacacaaggaagatgagggaggtgatttccatggagactgtggagaggctggagggtcttgtcttagggaagtttatcattcctttgcgcaatcttggtatttgtgacgtttcttttcttctttgcttctgtggaaagttggaaataagataattgggatagtggtttttgaaagggggaaaagtaattaagacacagtgggatgcccctgcctagtttgggaatgcaggctcagctctgctcctcaattgtttgagaccccagggtaaactacttgatctctagaatttcaggctcttctgtaaatgaggctgttggacaagatgtggcaaagattccaggaggccagggttttaaatttgagattagaatcttagtggaattttttgaattatggtttctctggctcgctctctccctacctcccttcctctgtctcgctctgtccacacacatataaacacacacagatgaagattttgtttttgtttggttagtgtattttatgttggacatttgtcagtttggcatttaataatatccatgtttcaatgtgatacatacgtgggacttggttaagtcctaaagtcagatgaactttgcttgtttacaactttaaaaaagaattccatccccttcttctgggagatgtagagcttggtagccagctataggtgtgctattgccaagtgtgtgtgtctctttgtgtgtgtatgtctgtgcattatacacacactttatgtaaatatatacatatatgtaggggtatatatatatacatattccaaaaatatatatatacatattccaaaaataagggtatgaggagccctggaggaattgcgggcacacacaaaatattttatttgaaagtataaataaattcatccaattctagatatgatatctcacccccttaagtaaatggaactcttacttgctgaattttacaaagagtgttacaagaagaacagagggctaaaaaatggtattcctagggccctattgtaaatatacctcaacgaaaggcaatatttcctgttacgttggttggcaaggggattttgatatcagaatgtggctccatctttcacattagaacatagctgtacgtggagatagagagtagatgaatggttgccagagactgagaagggtagtgaggggttacaggagaggtagggatggttgatgggtacacaaaaatagaaagaacgagtaagagctagtatttactagcataacagggtgactgtagtcaaaaataagttaatcgtacatttaaaaataactaaaagaatataattgggttgttggtaacacaaaggataaatgcttgaggtgatggatactccatttaccctgctgtgattatgactcattccatgactgtatcaaattatctcatgtaatccataaatatatgcacctactctgtagcaacaaaaattaaaaattaaaagaacacagctctgagctgcgacagtcagtgacatttaattcaaactcaaagtggctagtttatcatttttttccacttgcttttcttattattaaacagaggattttcactataggaaattagaaaatataagtaataaacggaaagtaaaagtcaagtgtagttctaccacccagagataattactcttctctttctgttcaatattagtccagtttttttgctttaggaatatgtatttgcaaaatgaagttgtactctaacacaattttagctaggtttttgcacttcatgttacaatatttttctgtcaaaacacctataaccctatatttaatggttctgtgatgatgtatatttacatattaaaacataatgagtgtatctcttcttgagaatttattttgcttcgagttcgtcattattatataaaattatgccctgaacatccgcagtatggaatggactttttttttgctaatacatatgcaaaaaagcttacttttttaaatgtgaaatttctaaattcacatccaggatgactgagcagttcatatacttgttgattagtgtcaaaatgctgatcctcccgtaaatcccctgatcgtcgtaggtgtttgcatttcattagcagcaaaacaaattaacaaaatttttgctagccatatagttttaaaagagtatcttcttggtttttatcttgcatttctctaattagaaatgagaaatcattagttagtaaatatcattagttaactactactgtggaaggcagagttcatggtggaggctagtgagcctgttctgtcttcatgggctgtgtgtcagatgcctctctgagggcttcaccgcaggcagtgatgtggtaaggcagagccaaggccttagaagttctaaaacttcccagtataatttagtaacaaaagatttttttcctgaaactcaagaacagtgttgtagatagagagtgggtcacatggagtccccaggtaacgtgtgaagctatctctatcagtcagctaaggctgctgtaacaaaatgccacagactgcatggactatgcatggaaatttattttctggctgggtgtcgtggctcaggcctgtaatcccagcagtttgggagaccgaggcaggcagatcacttgaggttaggagtttaagaccaacctgatcaacatggccaaatcccgtctccactaaaaatacaaaaattagctgggcatggtggtttgtgcctgtagtcccagctcctcatgagactgaggcaggagaatcgcttgaacccaggaggcagaggttgcagtgagccaagatcacaccactgcactccagcctggactctgtctcaaaaaaggaaagaaagaaagaaagaaaataatttatttttattttctaacatttctggagactggaagtccaagatcaagagtctgcagcagagtttgtttcttctgaggcctctctccttggcttgcagatggccaccttatcactgtatcctcacatggacccatcctaagagcttaattttaaattaatcaccaccaaatacagtcaccttttgaggcactagagtttacggcctcgacatatgaatggggggacacaattcagttcataataggagcagaaacacacgcactaatcaaacataaaataatttaaaacagtctagaggtcttaaattgtgcctctctctgagtgtagacagtgcatggagactgccctccccgctgctaccccacatcctgagcgttctgtcctcgtttccactgttctgctccattgtgtgggaggagctggagaagagactctgtttccaaggaagtgtggcctatgctgctctgcacctgggccttgcgacagccgctgcctccaaccaccacaagtctactgctgttcccactaataagtaccatggaaacccagtgcatgccaggggctgtggagaggtgggtgaacatcaaatcaccagtgacactggcttttcaaacgtcacatcataaaaatagagccacctgagtaagagcgggccacagcggcatcctgtagctccctgttttttggcatctacttcccttgggctcacagtcttctccatgaccagcaggaagactcagcactgcaactatctgcacgggttggtcgggctacacatgcctttccctagcatattgctaacactcaaaccagaaactgattaatttgatttgggttaaaaaatctgaccccatgaaggctttgctgatcattgacaaatctatccttcaagcattacagttttaagatagagggatgctgccttagtctctgccttttttgccattaaaaaaccttgaaaatgttatatcatagatagatacattctaataacagccccaaaactgatagatctgcatactcagattattgatcccaatactctcagcagttttaagccccgcccctgcccaaagggaacccctaccaatttaattcaggaggcttttggatttcatttaatgtggatgttatcttgttttgtttctcactatctgatgctattaccatcttaattaggttgaaaatcagcaattagaatcagaatgcctgtaatagttgtttttcttttgatcatagttatactcttaatgatgagattatgatgtgtgtgtgtccacgtgtgcatgtccatgcgtgggagtgtgtgttgtaggaagagcagtggatgttaagtcaggaagataagcttgaatgtgagttttgcttcttctaagatacctgaacttgctggagtgagcctccaggagccccagggtcctcattcgcaaaaagtgagggaatggctgttccttagattaggctgctttgaaatccatagatatcaaaccatcttataaaccaaggtgctgcacagattaataactgacacattggaagccgaggagtgtttagatatgtgggaactgggggcacattgaaatcattactagagggtaaatgttatttattctatgagctaattgcgggatttaaatttgggagctaaattttatcttaaatgttaaatattgtacgtaggaactggtctttggggggacaaattcaagctagtaaggactgttagagaggagaatgatgctgtgaaaatttaaatcccacaatgttgtttactagaaagatatccatttccaggcatctggacatgaatttctcagcctttgagaaaagccaacttaaccagcatgccctttcgatatgattgctccggaagcgtgggatgctcagtttgaaactgagttgtatgtcaatctctgatatctcaatttctgacacactgaacacaagcaggagaagagatgtacctctaaagagtgaagaactctctctctcactttctcgccatcctatctcgtgccatttctctttaggttgattgtttttaagaactggtgctcagtgcttagtaaagaatacttttctgaagcatttctcccaaagtgtatcttgatagattctgcaaactattaagtaagatttcatatgctgagatggtgtaaggtgatttatatttttggagaaagctaaaattcatcttactgacttttcaatctctccttattttcctcttttccatatagatatttagaaaagcaaagtatattagtagatttaatctccagaggatgagaatctagggctttttttttttttggttttctttaaagattgtatgataaaaaatgtttattatggcttaagggggaatgaaggtattcagataagttaattacatgaacaagcatgcctgattcctcttccacacagcctgtctcaagatccttcattcgtcaactatttcttaagcacctactacttgccagatgctgttttaggcacccagctccagagctgcaataatgatggagattttctcaaacccaacacccctggagcttacattcccgtggagaagttagataggaacaggtatacaagtaagataatttcagctattgagacatgctgaacagggttaggataaaaagtttgaatttatataggtgttcgggaggccacagctgaggtcatggtagttgaaatgagttcaaattagaagaagccagaaacggcaatacctgaaacagaagggtatcagaaagagaaaaatggaagttcaaggccctcgagggactgaaaaatggccagcgtgcctgagcataataaacatgctaaggagtggtaggaagtgaaatgggagaggtagaaaaggtcaggcacataaggaacttggacttgattttgttgtaatggaaaaccacagggacctaggtaggggaaggtgttgatatgctgtatgtttttaaaaagccactctggatgctgtgtggaactgcactcttgaaagctacacctggagacaagaagctaagtgagaaggccactgtgagatcctggcagcttagactagagagtggagacatagtaggaatgtgtcctggaaggtgggaaagaggacttagattgaaggaaaaacaggaatgaataaatcaagactccctcctaggttcccgtcctcaataagaggagggatgataccattattaactgggatctggagggtagagcaatgagttggattgggtggggggatggggcgagggataaaagagtggttttaagcatctggcattctccatgcttgttaggtgtgcaagtgaaccttttgagaaggtaattggatattgtgtggaagggagggaatagacatctattgaaagaacaaatgatatttaaaagggtggtggtgcagggaagtggatgtggagacccacatcagcactgaaaaccagtgatgggattatgcacaccatatagactgggaagtgacagggaaattcttgtagatgtagtgcagtggggatgttactatctctagtttttaatccagcgtgcatttttaatcacatgggggagatacaaaaataatatacccatgccccaggccccactgccccactgtagaccaatcagtctcttttttagagggaagggtaatggcaggcctcagtagtttttataaagttccccaggttattctaacatgtggccagggttgtgggcagctggattagaagaaaggaagggatggcctgctaatcctgttaggagggtggcccctggaactaggaagtggaagtacctcagtgcaacctcacactcattctttggagaagaaaaaggaagaaagtgagggggaagccaagtgtttgagcagtggagatgggaatcacaagacccctgccagcaagagcctttattcattcagcatggttgtcacatcaggggaagagcacattctggcccctaaagacgacaatggttgaagaaaaggtaaaggacaacttcccagatagctcctcagtgacagccacgtgctggaaattcttcagcctgaggtgaggctgtccctgcaactgtcagactcagatccctctcatctccagggttggctgaatctactatctgggcaaaattatgtgcagacaatctaaatgtttactctctatgacagtttgtcagtaatttttagtatgggacccagggttattaaaggcagggtgacatgggctgcagtatgacttgatgtaaaatatttcagcatgcattcttatctttgaccattaattccacttttaggcctttgtccaaaataaataaataatacgtgtttgaagagtttttttttttttgtacaagggagaaatacttgaaatatttgaaaagatttgctgacatgcattttctactgtgtaggcattgtaaatcatttctttaaaatcagagcatgagaaaacatataccatgtaaggtgaacttggaaaaacaggtttaaagttatgtataactgtggttatacaggaagatttcagaaaacaaacattggtaataaatacaccaaattgttaaaagcagctcttgctgagtgattggattatggtcaactttaattttcttaaatttttcatttacattttattttatctcattttaaatttccttaggttttcaggcagctcagatatcccacagttttagtaagaacacatattgaaatagtattttaaaagagattgattaataaggtcttaattttagatgagtttagttatgcatttttaaaactccgattctccaaatttggaataatggtttctgcctctcagagctgttacaagaattaaatgagataaccagtggggaaccatgctgtgcaatccctgatccatgttacaatttctttagtatttttgcactattgcctctgcttctaccaaggaactttatcccatggaagtgctacctttcacctaacattttgttagtttacgtgaaatagtcaacagatatgaagatagtttcattatttatgctgattgaaatgctgatcattggtgcaaaccggcatcccagcaggatgagctgtgattgggtgaaacatccatcatgattccatttctctttgccagtgactggcttggggttgggcattgtcctcacccaggagaggtaagggggaatgtgctggtggcagcagggaaggatttcatgtcctaattaaaagagagaaagctcctggagagtgtgtgtgttctgacctgtacttactctctttcaatgggaccttggtgcctggagctactgaagctgccctgggaccatgaagctacaggcctgaagatgaagggcctggcccctgttgactccgtggagctgccaaagcaactggaggctgtccacctttaggcatcttgttgagtaaacactcgggcgaagtctgtgggcctctgatagttgaatgtttgtcatacacagtcagcagcagtgcagttgacactacctgtggaagttgacatctggttcccaaaaacaaatagaaaggttggtgggaggagaatctgctgtgtgtttacatattttaaacatgtatggcaccctaggtttttctttctttttttttttttctttttattttgatggaattttgctcttgtcgcccaggctagaatctccgcctcccgtgtccaaatgattctccgcctcagcctcccaagtagctgggattgcaggcgcctgccaccatgcctggctaatttttttgtatttttagtagagatggggtttcaccatgttgtccaggctggtctccaacacctgacctcaggtgatccacccgccttggcctcccaaagtgtgggattacaggcatgagccaatgcgcctggccggtttttaacgcacacttcttataagtgcctagcgggattacaggcatgagccaatgcgcctggccggtttttaacgcacacttcttataagtgcctagctaacttggcaaaataatttcatttggtattcatacaaatttactactttaaattactccagaaattaagccaaatgaattttggagagtctgagaatcttaaacaaatacgttgtgaattacaagtttgcagaactccatatccagtgtcatgtcctgagatttagattcgcatatcagcaaggctactgctaatgacgctggggttttcaggtggacactgattgccacagtcactgaaaatttcatttagctgaattcctggaaaatgcttaagatatttacattttgataatatagaaatcaagagttaagctaatctaaaatttgtttgtatgttttataggtatgatttacccaattttgctgtcctgagaggaaatattacaaatgatagctaggtttcttagataattggagaaagtgctgtgtaaacatcaaaatattcagggcatttgttattatttatgcagaaatatagccaaaatactggcatattttcagttagcaatataatagtaataatagaaagtaaaacattttaaaagaggtttttctggaaattttttcctcaggatcacaaaaagtttttatttttcataagtatttcagtgatataatgagcacaagatacgttttgatgaaaagtaatgtttacatgaaaaaggaaatgcttattgatatttaaagacaattccctactctctctccttttccacatggtgaagtcgggagctccagatagaaatccaaagagagagaaagacaggggcagggaaggtacagtgtggaataatgtggactgtctcacatgacacttaagaggtcatgtgatgctagtgactttgctgatgtgtcaaggctagggctgagaggctgtgtccagcactgtcatctccactacctgaggcagaagcagaactgcagccggggcctccctgtgcttccagcactgaaagtaaagtgaacaagggttatgtggtcaacatgtgtgatttcttatagggaattttggttttgtattactaaaatacatagggtctggtgcaatgactcatacctataattccagtgcttttgggaggaaaaggcaggaggatgtcttgagtccaggagtttgaaactagcctaggcaacatagcgagatgccgtctctacaaaaatgaaaaaaatttgtctgagcgtggtggcatgctcctatagtccctattacttaggaggctgaggcgggaggattgcttgagcctaggagtttgaggctacagtgataccgattgcatcactgcattccagcctaggcaacagagcaagactccatctctaaaaaagaaaagtaaaataaaatacatagcttatgtatctgaaaaccttcaccattggatagtaaaaattcaatttattataagatcttaaacagaatccttgagaaacttaaatatagttaactctaaggttatgaggagagattgtgggacttggaggaaaggttagtctgtaccccaaatcacatgatttttatagaaagaacacaaaggatggttacctgtgggcacattctggaccacttacatgtttacttaacaacagttccagcagttctctagtgtgtgtatgtgtgtgcgtgtgagtgtgttcactttataagcaggtaacttcctgcctatataaggtaactttcacggatttcagacagtgtaattgtagttactgggtagaagaggtctttcatgaaatttgcaaggggatctctgcgtattttgtgagtttcctcattgttctctctataattaacctcacagggcagaggatagtttcttttcttatagatccatatcacaggcatgattctccagctgaattcctgagctcaagatttcctttctaaataaaggaaagggaaagaggattttctcgaggtaatggacaagagttgggaaaagtggttgcagatatgcttgatgctaaggaagccctggtgtatggactgttatgtgttccctcatcccctaaatttctgtgttaaaatcctaaccccatatgctggtattaggaggcaggggcctttgggatgtaattaggtcatgagggtggagccttcctgatgaaattgatgtccttagaagaagagagaggagagggcttgctttttcctttctctgctcttgggcatttgaggatacgggagcaggggatgtctgtaagccaggaaggtggccctcatgaaatagacctgccagggcctcgatcttggacttccctgcctatagaataatgagaaataaatgtgtgttgtttcagccgcctagttcatggtatatttgttatagcatcctgcactaagacacctggcttgcagagtgaggtgccttataagaaggtaggatacgtggtttacacacaggtagccacagggtgcagggtgcatctgtaagtcaagtggttacaacctctgcctctctaggattaaaatctttggcactggagcgaattttatgatccatcttcctgaaggaaaccaataaaaataatagtaaaattgacaactaactacactgtattgagcatttcctaagtacttgtcatgggttgtaaacaacatctcactcagttctcagtacagtttgatgggacaggtactattatctccatttcactgaaaaaaaaggaaacctgaagtgaacgataattaagtttcgggcccaagttctcccttcttatgatatgatggttaggttttgtaaccagggttatgatttaaaaatctctgttccatttccccccatgaactcttcacttatactctaaaatatctcaaaagatgcttgtactacatgtaatatggcatgcgaggaaatggattttttaaaaaattttttagagactcagaggccgggtgcttcaggctcatttttaccacctgacccgcgggtacacagcatgtaattgtatctcaaaatcatttccagatatgttggaaagagcaataggaccagctgtgtttctcataaaagattaggcacaagtcatgtatgaggtttttctctactctgacttgtgaaagtccaagcagtgggttaacatgataaaggaaaacaaaattaaataagctggtgtaagcataacacaactgacttccagaagggagataaatgttgcatagagacatcatatccagccaaattgttgcctctggtatttccatttggctaatagtgcttaatattggttgaaaaataaaagtatgccgagaactcgtatatcatatggtcagcattgcatggtttcgaacactccagtgaacccatctggagagtttcagccaccagggcctgacagcctcattagctgcctccacaaggccttgcccaagcaacagtacaaattgctgttgtttcagggcgatggtgcagagttaaagaaaacaaacatgttcaactgttttgtgttttccatgttaaaacctaaagatggaaacctaattattcagagattccagcagaacactgagccctcactctaaatttttacagcagttatcaatgtgcttaagaaatgtgaatcaggaaagtgagtcacatgctcaacatggtaaacatgtatatatccaccttcaagacttcagagtgtgtatatatatatatatatatatattttttttttttgtttgtttgtttgttttggagacgaagtttcactcttgtcacccaggctggagtgcaatgatgcgatctcagctccctgcaacctctgctgcctgggttcaagcaattctgctgtctcagcctccctagtagctgggattacaggcatgcaacaccatgcctggctaatttttgtatttttagtagaggtgggatttcaccatgttggctaggttggttttgaactcctgacctcaagtcatctgcccgcctcagcctcccaaactgctgggattataggtgtgagccaccatgcctggcccagagtatatcttaataaattattatcacaaatttgcatcctcatggaatctgagtttggaggaaatctgatgagctcccagtttaattatcatccctggtataaatctcttgactgttcccagacagaaagggttgcttagtctctgcttggactccttcaatgctaagatctccttagactttaccttttgattccagatggcgctaatcattgaattactgtctcattagtcaaattccaccttctacgcctgttcttaattctaccatctggggccaaaataaggagcctgtccatgttccagcagacttttaccaggtgaggacttcagtcgtattttcactgggccttttcatttctcagataaatcagcaatcttttgtttctatggcagggtttcatgttccctgcagcattctggttgttctccttaggagtacagttgtttatcccaaactcccaaaccgcctcctttgtaaagaactgtgatcattggcaagtaatctcctctcagcccatgtttcctcttctgtaaaatcaggatatcatggtacctgcctcagagggttgctgtgagaatgaaaagagatgcagtgagttgaaacacagtacccagcaagcagtaagtgctgaaaaaaataagagcttctcttaccaaagtatctcttaattcttaatcccagtactaaataccaggcgtccagaacaggaccatcctgaccctttcatgcagtctcctcctcctcccggcttcatataattcatgaatttagcatcatgctctgctatctaactgtatcaaaaaaggaaagggctttcatttggctggatccatggttcatgagtccacatttgccttaagtgatcactgtttccaatttttatacacttacaaaccactcttcgtttttttccttagttcatggattctgtcatcttccccttgtggaaaatcacaaccttcttcatgtcttcagagttttttggcagcttttcccactctccaggtttcccattcctctaggtttgtagaacgtgttctaacctgcaaagcctctggctacctggatatgttattttttggaccacagacctgagttacagggttgagttgggaagttctctattaccgggcatttttttctggccttcccacagaccatagaatcagagaggagttgaaaaacaatattttcttttatatcttttagtgtcgtttatatagccaaagcaggagacagaaaaacacccttgggcaattcaatagaacataacttgagagacctggacctctgattagtcttgtacttttgtcataatttttggttccttctggaagttaaggccgtttcctactctgtttttacaggccattactggcaatcagcatgcagtttaactgtgcccagtttttgtgttttcttcatgtcctttgaaaatcagccctcacactatggctagattgaatgcattctgtgcatgcattctattctgctctaccctggtattgtttgtgttttttgcataattggaatttgccttcttaagaggtttccaaatctcttgggccatctttattagaggaagcagcactgtacaaatgtaaatagactttaaatatttctttagccctacagtttataatgttgtttggtcatgtttctttttaaagacttcgggattagagtaatatgtcttaggggcaaggagactcttctaggtattctttgtcttagtgactttattaaaagggtaccttgttgtaatgtacttacctcacaaagtttttgtaagaatttaatggctgttgcaattaacacgtaactgggtgttacagaacacccagagtagtgccaggcatgtgttcatggagtgttggctactactgctgttcttatcatcatcatcatcatcatcatcatgttcattggaaacgaaaatttcagtttcaaagaaaaaaaacagaccctgctcttcaatacagtatgcagccaaatgttcgtttcccagatgctctcattttgtcctgaatcacaattgttatttcaatgaagagctcctccttcattcaattgctattgttgtgaatactattttaaatagagtgcttggagaaggcctttctaaggatgtagcatttgagaaatttctgagaaagccaagaaactatctgcagggcatgtaggtgagacggggaagagcatgggcagtgaccatgccatgggagtatgtttgtcctgtgcagaaacagcatggcgtccaatgtgacatagagtggagcgaagtgggctggcaagaatatgttgccacgtgaggtctgagaagtagccagggtggggttacaataagaactttgaatttattctgtgagagatgggaaaaaattagaaactgctgagcaggagtgtggttggcttgtgtagaaaatagacgagatggaggcaggagtggaagcaaggagaacgtttgcaaagttatcacagtggtcttggtgaaagatgctattagcatggcctggagtgggagcaaaggagcgggtgtgaggagttctgatttcaaagatattttgaagatagtgtagagcagtgagggtctagaggattagtcagagagagaaatcaagtagaactggagagttctttgtttatttgtttacctgtgcaaaccagctacttttggagagagaagtactagagtaggagaggtttggagtggggaagtcagtcctttgttaaatttgagatgcctgttagacttccagtaatatatgtgatcttaggaaaaatagcaccatttgaagacttttctagcttccatttgttacctgtgtcacacctgatctgtttctaggaggatgtcaattatttaggagaagaaaaccaccaactaaaaatttaaacaaaacaagtaatagacttggtttcaaaatcatgatctgcttcttttaagagttataggggacctgcatccactgcctaaatgaaaacacagtcccttccaaatatacatttgattaattagaagctcaaagctctgtttttactgctttaagagaaaaaaattatcaccacattatagtggcaatttctctgatggaaactgaaatagtggatgatgatgatgatgatggaaatttcagagtagcacacaccttattgagtgattacattttaaaatatatgtgtattcatttattcatataatcgtttttaatgagagcactctcttaattacattatgacactgacttggtaaaagagaaaaaagatctctactgaaactatccctaaaggagctgatgttatggaaactgagatttttaatatttttagctgagaatatttatattaactggataactgcgaagatcacctccttttgactataaatttggagctgggttgtacagaattatatttagctctgggaaactaatcttaacagtgcatgttttaaaatagtaaggcttctcagtttgtacaccaaaattacagactccttgatacccttcttccaaaattttcagaagttgggacttagaaaagtttcattttgatattagagatggtatcttacagcactctgatttgaaagctagtacaatgaggtgactctcaaagaacaaaaggaatcaatatgcctaattgtgtttattgctactttttcatctttgctagatgctttagaagacaaaggccctctttaatttgttgatgcttagatgcatgatgtaatcttcaacagactgatctgcgctctcataattccaaagtttcttcccgattgcttgataaaaatgcaaccttaggtatgttttggaagacctccaagttatttcaatgttatgcaggtatatagaattaatattattgatacacatcttagcagtagaaacattttcaattatgattagaaaacatctttcttaaatgtcatcatttgatatcaccagtgatatcatagtgaatatttaggcaattttatccctgggcctagtccacacacatttttctagtaaagttgactaagacattcatgagccaatacaatgagcctatgattggtaacagggtggggaatgtctatacctttcatatattgcatcccaatattctatagtaggtattgaaacatgccgtacccacttctgtgccaaggagttttgtagaggtgatgagtcaggaaatccaagttctgatctgattctgttagaagctgattcactggctttgtacaagttatttcaagtttccagagattggtttccccagccatatgattacggggttcaaatgattgaactttgatgtttcatgttaaaccacctttgttcctctctatgtgggaatgggaaaaagtggacacctcagtctcgaaatagaagtttggggatgaaaaaggagagaaactaagtttgtaaccacagaagtgggggtcagacagcatggtttgagcactttcatgaatgcatctggtgtcagctgctggcctctaaaactaagtcctagtgttcacctgagaaggagttatctgtgttctctttcccatactgttttaccagtaaagatgatgatgagagaggtggtggtgatggtgttgagagtgatggggttggtggaggtgatgggagttgtactagttttctaggactgttacaataaagtagcacaaaccaggtggcttaaaacaatagaagtgtattctctcataggacctgaggctacatgtttgaaatcaaggtgttgggatgtacctctccctctgaaggctctagggaataattctttcttgcttcttttagattctagtggttgctggcaatccttggcattccttggcttgtagatttatccctccaatctccacctccttcttcacatagtcttctcatttgtgcatctatgtttctatgttcaaatttctttcttttttaaaacacactggccattttgggtttaaggcccattctactccagtctgaccttattttcattgcatctgcaaaggccccattttcaaataagatcacattcacaggttctgggtggccatgaattcttggggggatgttgttcaacccagaacatgagtggtggtaatggagatgggatggtggtattaacgggtatggtagtctgtggtgagggtgttggtgatattgatggtagtgatgatgtgggggtatccaagggttccatctcacatgatatgtactcagttgtagcaaaaatacttattgtacattgatccaaaattggctgcaaacctgtgactggttcttggcacatgcatcactacagagtaacaacaacataaaaggcctattgatgatgtcttaagggctctttgagaagtaaggggaggcagaaagcagttgtatcctcatgacaccgaggcagatgtttccgtctttaggaaggaagacagcatttctctgtacaaagcactttcagtttttacagagcaataatatttaaatgtaagacattcaacttgtaatcaaaatgggaaatagataataagacctttaaaggaaatatgcgtgatgcttttgtagtccatgttcaggatcatcttcctcttatttcttataagaaattttacaaggtctgtcctcatgtcattcagtgggcctgaaattgtatctgtttttccccttgctctaaaagttatattgaaggaatgattttgcactattgcacactaaaaaagcccctactcagaaattttaaaaacatctaaactcatattcagatatagtggagtaaatgaataattgtttcagccagagggttttctcaattagcattttaaggtcaaaatttaccctagaatcctgtagaatcagtggctgtgagtcacctactctttcctttcacataatctatttcttgctgtccacctactaggcaccaagtgaaataataccctttttatgtttctcagctctagcttgcagagaagagtaaagagaaataactactcagggcaggaagatatttgcaagaaggtagcaaacccccaaatccctttgacggtgggaacatcaaactgagcccttgaagactagagttctgggtactcaataatgttcaaagtaaaaatacttcagcaaattggatcaacactaatttataaactaaattaaacaacatgcattaaatgtaatctatgggaagccacaaaatattttgctttgcatattttttaaccttagtgataacaattcttagaccaaaatagaaatctccagtgttgcctgtttgtcaaggaagccttcttcattatatttcaggtggaactaaggagcacaattattttgataaacttcttttttactttttcattttctagagatagtgtcttgatctcttatgcaggctggagtgcagtggcgcgatcatagctcactgtatcctcaaactcctgggctcaagtgacccttccacctatgtctgtctcctgagtagctgggactacagatgcatgccaccatgcccagctaatttttattttattttattttatagagaaagaatcttgcaatgttgcccaggcagatcttgaactcctagcctcaatcatcctcctacctcagcctcccaaagctttgtgattgcaggtatgagccactgtgccaggcctctttcttacaactttagaatttttccataagatttctcctgtaggtaaagccaggttattcagtggaacttatccttggaatatatgtaaatttgtgccagcagatttttttgtcttttttatttggttgccaatgttatgatagccatttctttctcatcagtttggttcatgctgaatgccttgtgttggtgaaccttactgctatgtctttattagcaaagcctcagaggtatttcggcatttggccaaatatttgcaaaatgtgccagttagtcaagtggagaattcatttatttttgggcaaataatgggtttttaaaatgggattttcaggtaaagtgctactacatagtgaaagcctgctatggtgcaaagcctgctatggtgcaaagcctaggagatcaccaagaaccagcccttcccttccctccatttcctgggaatcacagtgtcccaggaagctctcatctttcattagctattgactgagagagatttttgcagctgcaatggaaatgccctctcgacagtgtcacttgcttttggtttaagcccgaaaaaggtacagcaggtcaagtcccatttgctgctgtttgactggagtgtgggcttgtgtgtgtcttcaccctctagcacagacttgttttttttttttttttttttttttttgatgagactacaaggaagaacacttttccttcactgcatgtattttactgttattattgttgaaaccattccttccacctccaacctttccccgttaccacacacacacacacacaccccaaacccgaaaccaaccacaacagcaaaaaacccaaattatataaagggcaaaggtaatgcagttaatctctgaattactttggattcctaacaaagaaagaacctaaacaagaacagcatctgtttaaagtaaaagaatgttttcttacaaaaaatattgttattgcttattttagaattgccattatgcttctgaaacgtactatgagagtaataaatgttaattaccagagattagaaagtgcaggcaaggagaaagataaaaaaagtctccaaaattatactcaccagaaaaaaacaatcaccgttagaaatctcagggtaatgctttccagatacttctttttctttttccttacttttcacatttttttcttttactttttgtattttattttatgctttggatggggatgtaggtatatgtgagtgtatttgagtgaacacaagtatgttttttcatataggtcatgatgatgatgatgatgattacaggcagtctttctctgttgctcagactggagttcaggggtgcagtcatagctcaccgtagcctgaaactgctgggctgaagtgatcctcctgcctcagcctcctgagtagctgggaccacaggtgtgtaacaccaaacctggtagatttttaaattttttgtagagatgaggtctccttatgtttcccaggctggtctcaaactcctgggttcaagggattctcttgccgtggcttcccaaagtactgggattacaggcatgagccaccatgcccagcctatacagaatattattttgtatcgattattctaaaacggcttaattctttcatgttctggtgggggagcaggtagcagagtgttataagagagaatatcccagaataagtgaccagagaaatcctttttggtgaatgacatttatggtgagatattaaggttgagatctgttgtcatgctaagaatggggagacgaactttgtaggtagcagggatcccagttgacaaggcctttgggtggaaggagagcttggctcactcatgcatctgaaagaaccagggggctgaagcacacaggaaactggagagacaagatagaaggtgggcagggatcagatcatccaggcatcttcaaggccatgcttgtttaacttaatgtattgtgactgtctttctgtggtcaacattctaaaagcggtagattttggtgttaagagcctggccactggagtcaaataaatccattgtgtaaacttagacaagctaattaatgtcccctagttttaatttccaaatctttaaagggagatgattgtaggcaatgtctgaagggaccattggggaaaaaaagtcagattatacgtataaaacaatgaagaggctggcaccacttttaatcagttttatggttgaatttattcaacactcattgatggagtaaccaagggcttggtcaagaaaggttatttagcagaagctataatggagcttcaaagagcagagcagtgaaacttgtacttctcctcctcaccacctttggaataatgagcccaggtgctccattgaccagcgtcctcatgcagagccaagtgctattactgtctttttaagttcttaagggcagaaccgtggcttttcttacttgttcttacccagcaccatactctcactcaggacttttttcttttttttttttctttgagacagagtctcactctgctttccaggctggagtgcagtggtgtgttctcggctcactgcaacctctgcctcccgggttcaagtgattctcctgcctcagcctcccaagtagctgggattacaagcacgcaccatcaggcccagctaatttttgtatttttggtagaggtggggtttcaccatgttggccaggctggtctcgaactcgtggcctcaggtgatctgcccacctcagcctcccaaagtgctgggattacaggcatgagccaccgctcccagccagcacttttgaagtagagatggttggtgaatccacgtggaatgtctgataaataacgaaagccaccgtgaatcacagccttttctttccagaagggagatcacacttttactccagtgcagactttatgtatatagaaaaattgaaacatactttaaaagatgtttaaaatatatttcagcttttaaaaaggaggttgaaaatctgtaaaattgtatgattccattaaaaacatggcatacatccagagctcttgtggcacttgtatcaagcggtacagctatgcacactctctaaggcgggcagctgtaagggctgtcctctgcttctggcatgccacattggctaaatatatcgaccatcacctctgcatgcacagcagtaattattgacgtattcctgatggttttctctggctgtgaaattatgggaaattaaatatagtttatatttttacaatgaacacgtattacctttataataaaaaataaaattaaaaatcacttaaaatttcttcaattcttttcacactcctcttcatgtaacttcatatttgtatccagcactcacaactccaaggaccatgcccacgtattcttttagaattttaaaaataaattccagtaggtctttcaaatactgaaatctcagcactgaagtagattgcagtggggcatctgatgggtacatttcaaaaatgctcaatttgctcttaggagacttgaattggccaggcgcagtggctcacacctataatcccagtactttgggaggccgaggcagcaggattggttgagactgggagttcgagaccagcctgggcaacattgcgagaccctgtttctgaaaacaaacaaacaaacaaacaaacaaaaatttaaaaatcagctgggcatgggggtgtgtgcctgtagttctagctactcaggaggctgaagcaggaggattgcttaaactcaggagttcaaggatgcagtgaactgtgatcatgtcactgtactccagtctggacaacagagtgatagcctgtctttaaaaacagaaagcaaaaaaaaaaaaaaaaaaaagaaagacatgaattgtatgattccatttttgctttggtcatttactgggtgtaaactcttgggttttccttatctgtaaaacagagaaaacagggcctcctttatgtgagttatagattatctgatgattcaaataagatatgaaagtacttttaaactaacgacacaaatactagctgctatttatttaagttatgattcattaattagtgtatcctgtgaaggctccagttttgtttttatcaaagatcacgtggagaaatggcttgcattgggataatttataacttattaaaagtttgcttctcattaagggactattctctttggaaattaggtattaaatatatggtttttgtggcaacactgggatgtgtgctgtactgctcctccctaaaaaaagatcttttttatattttaagcattaatcagacttgaggctatttgctttcccatcctcagaccctcaagtgcttgttgtaggttggattgtgcttgatattcagaattgagtataaaagcatgtgctctgctcgtggttggtcagctgccttggagaggctagattcttcatcatggcacaattacagaaaaatacagggttttcctgagtggccaaaaaggagatgaggtgggtgttgggcaattaggaccttatttctttaagtttctcctgaaattgttaaagtcagctcacacttctttagttttttttttttttgccaaaacacaaggcatcaaataatgttggaaaatatccttggtgctcagctacagaagtttcttgaatccacaagtaataaggagctatttggcatcattaaatacggagtgtgggtttatcactccagtaaatgaatcaggagagaatactgagttagcttcctgctgagatgtggaggacacctggagtttatctagcacctctctgtgagatccctgagagcctcctcgatgagaatgcaggtttattccttctacctgctgaggagacagaaaattagcatgataatggtgataattgttctgtcctctggacagcctggacatcagggaagctttgaggtttcagtaaatgcttacttattcctctgctcttggtacaggcccgtctcttggtcaagatgagagatacatagaaatataatataagccccatctgtaaccatatgaaaaaagtaaaaagaaatagacaaattaattttaatgatctcacttaacatatctaaattattatcatttcaacatgtaatcaacataaaaattaatgaaatattttaaattctttttttagttgtatgctacatattcaaactctggtgcgtactttttacttagagcatgtctcagttcggactagccatgtttcaaaggccttttcaccacttatggctagtggggaccatgttggacagtgcaggtttattccttaccaacctggcccatagtagaaagtgctgtttccatgagacagcctttactcctcagtaagtatttactgggcatctaatatttgcagtttactacattttggttatataaccatataacttgaatttaatgaatgaatcaagaaacataataataaatagtataagtaaagtttctggatatctgtttgctaactgtatgatacagaagcagctgagtatgagttttcatgaatttgcagtgtagctttgggatcatccaagttacaattataggctaggtgacataaaagacattggcattggggggctttgtgtagcatcaggaagagctagacagtcatctcctaaaagcaggtgaaactgaaatagaataacgaacccaagggtctgctgtcgaagagatgtagtgtactatttaggtgtcagagactgaaaaaatacatagtgaaggtggctatgagcacaaactctagtagaagggcaggcattgctaattacaggccttgatttgtatttgaggcacatcttttcttgggcatctcctgagttccatgaggacagccaatgagtagtgcctaataattgtactgcctttctgccaggtgccaactcatgttcgccaatgtttgaatacattttcaaacttaatttttacaaaaaatgtcatgaaataggcactattattatctccattaattaatgatgaaattgtaaatacactgatgttaagaagtgggactaggaccacatgggtattaagtagagggaccaaaactttggcccagttttatccaaccccaaaacatataattttagcttataattctcttcaaattagacaataccatggctcaaaatataaataactagtcagagattaaaacatgtatctgtatgaatggagaagcttgattgcatgtctgattttaaccagcttagattaaaattaaattattaagtgtacttaaattaacttattcaagaaccaattcagaggccactttctataaagagccccacttcaagtcccttatttggaatgcatctctccttcctcggctctccccaaacaatttacacatctcttggtgcataataaccttctcttttgattatagttatacatgagcatgttttatctgccttttctctccagccactacgtgtgtcttgtacacaaaatagctcctcaaaatatgtttcaaatagatgaactaaatgactagatggatggaaagatgaacaaatgaataaataaatgaataaaactattcctgtccccttcaaaataagagaagtgtttgtataaattaccttgagagtaggtaaaaaccctttgcaaaaaaccccaggggtaaaaccctttgactatggcaataatatgcaacataactattgtaagaggagggcagttttaaaaattcaaatagtcatgtacttgaaatattaactattcaactatgcgtgtactggtttatcatccagcacatagatacagtttgtctttcacttcacaaagctagtttcatgcattttagaaaacgtgtttttccctgacccccctccaagctgtacttgacagggacaaaactgagagcattgggcactgcaggaatcattgtgagctttcaggaggggaaagtcatttctatgactagtacttttcaggagacatgggtgtggttttctcttttcgcatgttttagacaaaagtggcggactgatgagtttaatacaatggaataccatggcttgtgcatgagggagtaactttttacaggaatgtttattatctttgtcatccgaatccatatgccatgctcagaaaatacaatggatctgtgtcccgagtggaacagaaatagttttttcatgctgaaatgtgttttggtcaccatttgacatttttaagaagcagctctgtgaaatatttttgaaagtggatttatgtattcatattcattcatgtgctgttttttcatctatatattccccatcttattccagaaaggatttaagctggctcatgcatttgttgtatttggaatgtttctttataggtcaaggactagtttcccagtgaattgatttaaagaactgcagtcctctgactcaggcttgaattcacatatgatattggccatttgggatatctctctgttatatgggcagagtaaacacaagtataaatctgtgacaacattttggatttctcagatcaggtactccatcatctgctttttatcacgtacaaaagaaatacaaggccatttatttccctattaccctgtgttctggatttttctatttataaatgatattttatatgctctgtttagcagttagtaatgaagcataaagggaagccattttaattaatgccttatttgcatgtgtagcatgcacctcttttctttgatattattggaaaattattttaaattcagtcaaaagaagatgctttaggcaaatgaggacttgctgatagagagctgtattattttattttactaatgaaatgctgttaattttttctctgtattttacctgctgcaactggtttccttgactttgttcatactactaggatttttgcaaaaaacaaaaacaaacacaaaactggccataagcattgaatagaatcattgcaattttctgtcaaacgagttttgaaatacatctggtgtttaacaacacattgcttatttatttatttatttcaaatcattaactactattgcatcataacaaaacacacacacacacacacacatacatacacacacacacacacacagctttggttcaattatactatatagccctcctgtttccattgtgtttgggggaagtaaatgtaataaatatttttaaattcagtaacccatctgttgaattcttgttggaattaactgagagtttgtatggaaaaggcttagcctagaacttcatatgtatgggactaggggatagagcacttgaagggatggcatgggccccagggctgaaaagaagtgctgagttaggataggatataagaatatataagaataggatataagtgtggcagcgctgaaaatcagatggacattgcttcaaaaccgagcgtcgacacttgatctgatctgcctcttaaacctctttgaacgtctcctccctaatctgtgatggcagaatggtaatacttattttgaagttgtgtcaggattggtagcagcgtgcagagattacagcatgtattatgaactcataaataacattgcctggggtgttattttcattaacttcatcatcatcatcatcatcaaatataatccattgcttcaaagaatttatagtctagtaagggataaaaagattgtgtgtttgtattaaagatggggtggaattcttattaagtatcaatttcattgccaacatggacatggcaaatgacaggttcccccaaaaattattgagggaaactgagattagatattgaggagattttgggacaccaaaaccaaggcaaatgaagcactaaggcactcgacaaaatgagacacccatgaatgtccagaggtatcacctcagaagttggtctgaggggcaattacacaagcagagctgagcagaaacagtggcaatgaggggtgagtgcagccaaccaggaaacctgccgtcaattgtgttttattcttggcaaggccttatttgaagttttctttcttgattttgttcttccccgctactgctagccacatctgacagatacactaatatacgaaaaattaaataacaataaaaataactttataagacgtgcctcaaggcagaatgaatatcaagtaccagatgatgatggaaagaattctgctggagttcagtggacacagctgtcttatggcctgaggtgtaaggatgacactatgagaaagggagccttgacttcacttttgaagaagtgtgcagggagcacgctgggaaaaggagggctggaaaagagatgagatcttgctggatcaactgaagcacctgccacctgcttggcaggacaggaaatcttaaagtcaatgctcctcacccttagcaccctgcaaccaaaaagaaaattcgaagggttcctcactctatttgattggagttttgaagaatctgtggcatcgattcctggtgctttgctgcccaggcacccctaatcttagcccccaccactagggggcctccctctagtctccttccttctaagcattgatcacagcccactcaggtttaataagcatgactatccatgtctaaaaaaaaaatgatactttatgacatcaatttgttgtgaacttttcaagcttttcttcccaaatagcatatggatattcaatttggaaaattttgatataggtttaaacaaaatcaaattcaaataatctgtaattatgccaaccccagaaagctaatgcttttgcttatttttagatatacttccaaatttataatattatgaatagtagtacacgtcagtaagtacacatcttatttcacaaaacatgggctcacatttttctaattcatcttattcacttaatgttttgtgaacatttttccttgttatacatctacttcagtaacattttttacaatctgaacagaaattaattgtatagaacagaacaggattcctttgttcatttttatatatgtttcttctaatgtttttctcataacctaatatgaaagtgataggttgtggctacatgtttacttatattcataataacattttaggatatattttgccagaatgtattttatggtcaaatggtatttacattttaagtctttttggtatgtatttgcaaattgattttaaaatattgatattgatttatgtgaaatgggaatgtttgagagtgccccttcttggattcttagccaatactgaggcttgttataataaataaataaataaacaaataaaagccttttctcccactttgatgggagaaaaatgggattccatcatattgtcatgctaatctccactaattataattgctaattgtattatttatttgtatattcttgattgtgatttgtttgcttataatatttgcctaatcctggaggtatttatacttcattatcttattttagatagttcttaatatgtattaataatagtaactccatctctgaaagaaatgccaagtagttttgcttcacatagtctgtctgcttaatatctatctggatttttccccaagtcaaacctcttagtcttttcttttatggtttttaacttgttaagtaagactttcctcaattccaattattgaaatatctatctatctgtctacatttatgcctactatgtttatgattggattttttatttgtaagatttaatgtttcttaggttatttttgatgagaataaaggatccagtgtgtaattttgactgcttgtacatatttagtctgttttgttgttctggccattcctttttagtagcaagcactataacattcagggaaattttcaataactagtaatgcacatcttaaaaatgttctgactgttttcacttcttatgaaatttagacttatttgttggaactccaatacaatttctagtgaaactatgaatggaaatgacatttatgttaatttgagaagtaggttctttgcaatatcattttttatcctatagcaacatttgtctctctattcaagccttcttttctgtccttttgtggaaatgttatggttcccttcatataataaggtcttatacagtatattcccaagtgtttgcattttatccttgtctcatttcttgatttaaatggaatgccccaggtattatactatccagtttaaatgcccactattgctatttagacattttaaattaggaatcaatgttgaaatagttaacgactttttttgtcatctcatcatttgttaaaaaattttttgacttagttatattaggggttaaatttagaatcccttatattggcactaacttgatcgttttttaacaaatcctcctatgataatgttttgtattattacatgacttttttgaataacacaagtgcagttttgttacatagatattttgctcagtagtagcttttagtgtaaccatcacttgaatagtatacattgtaccacttaagtaatttctcattccttacaccctcacatccttccacccttccaagtttctaatgtctattattccacactctatgtgcatatgtacatattatttagctcctacttatagtgtgaacatgcagtatttgacttttcgtttctgagttatttcacttaagagaatggcctccagtttatctccattgctgcccaaaacaagacattgatttaataattaggatttcagatttacattcatataaaaatttgtctttagttttttcttttcctgtctttcggggggtcaggtgtgggcatcagttgatgctagattcttgatttgtaaagcattccatccttttcagtgctccagagagaaaatatttgaaagaatttacgtgtgagctgggtttggaatgattgttcttaaaaatatttttaaatgtcccaaatatttgctgacagatttatagaatgtctaggatttgcttaaaaagagcctcaggaacagcatggagggaggatctgtgggagtattataaaactctgagtatatgggctggttccttgtacattgttttgcttttatacatgtttgacatattcaaaaaagtttctaaaaatgaaatcacctgcaaaatgttttcagtggtggttacagattttctaatgcctctagtaattttggtaatttacatattattaggaaataatgagagtttaatattcttaaacatgtgtttttatcaagtctcctgtgtctaatatagtgcatttctgttttatctcttaatgagattagaatttcactttaaaatcatctttctaactcacaactctgatcagactacctacctgtgggcaactgctttacttactcaatcgaatttggaatgcggtggcgcgatctcggctcactgcaagctccgcctcccgggttcacgccattctcctgcctcagcctcccgagtagctgggactacaggcgcccgccaccgcgcccggctaattttttgtatttttagtagagacggggtttcatcgtgttagccagaatggtctcgatctcctgacctggtgatccgcccgcctcggcctcccaacgtgctgggattacaggcgtgagccaccgcgcccggccgaatttggaatttcttgtggggtaggcaacaaagccttcatgcgctgactccaggtgcctctcaaacctgagccccagctttgttttctcctccattttcccacactcctaagagacacttggaaattcttcctcctcagcctggggtgctgtcagctgtaaaacagtgtccatcttctccaagacccccggagaatgctgtttctcttaagccttccacaaattcccccttgttttatcttctgtcccttctctgaaccacataatgttttgttcagactgtggtatagccttaattgtactgtatgacgtttgcatgtttggaaacccaccttgttcttttttccacctactctgctagcagaggcctttgccctcaggtggcatggggagaatatttatagggtgagcatgtagaaacaggctgcgtatgtgccttaggccagcagtcttgttgtatgtctgcagcactgaaataggtgctcgttaaatgtttgtaggatgaatgctgagtgaatgcagtggacaggatacaggcaggtgattgggagcccagtaggactgaccccggtgggattagtagagagaagtagtgggagataacttggggtcatgttgtcattcacagtttgtggatgggagcaggtagggctggtggtgactataggaggcacagaacacgtacacagctcttgctcttcagaggttaccacaacaatgtgtatcttttccaactcataattagtagaaatgatgtttgtattaaggtaacagaaatatgctcctaaagtactttctcattatatccaaatcactttatcatcatttgttttactgtagttacaccacaatgtaaataaaagcatttagaaagacagttgtctgaacttcaaagctgtttacatagaggacatttgctagactgggcttttcctccatgtacccttgggtgagcttgtggtcttccccctaaagatcacaggctattttacaagttttcttgtgagctgttcagctttcttataagcatgagttacaccagggagttcatttgggtggacagagtccagaaatgtcctgtttcgactggtttgtttaagatggccatcaacatgtgaggtagggaatgtggactttctattatggggctttttaagactctagaccatcgttcgaattaatttcgttagccaaagttttaggccttttgtccagtgtgctcatttgcttcttggtttgctggtattattcagatcaaagaaggtcggtcactggaggaaaatggccagcatccataacaatgtgtacagttactgttgtttaattgagtggatttcctgtttgataattactattctgtagttcttgtgtgtgttttgaggatgagggaggagggacatatatgacatttgtatatttgcaggtgaaagagaaaaaaaaggcctaaagaaggggaataattaaatatgcttttagattgtcaagcttcctttcagtcctatgctctgtgtgtttgattcaaagctatttagagaaagtcatcatttgacccctgtgagatttcttccctgttgtgcttcaggtctcaaagagcttccccagataaattacaggccattaattgttaccaccaattatactggcagacatcaaaatgattttattaaagagctgtccaaagatgtaaaagcctatcttgacaagcatgcagccatgggcagtgtaatcactcgggaggcatgatatagagggaattgaggcacatgtggaacctttggtctagtctgactttcatcactttgtgcaacagaatatagaattgggaaactccatctaggaagcagaattctgatcacctgtatacagttccaaagcaagggtttgaattaatcatttctgcatttccaagacctaacatggcatgatgtggaagcaatagatatgtatggacttggatctaattctgaataattgattataattatcatactccagggaaatttgtaagggctgccacactgaggttgtgcttgcaaatatgaagtgcaaattggaattaattatcctggtcttttttagggaaatactttcttttgtcaatccagatgagtgatgaaaaagtaccttctggatttgaattagctggataattcttgactttgctcaagctttaaactggtaggagctttaatggctattaattagtgtgaaagctttttattttctgaaaaaactttttttttaaaaaaaaaagagaaatccatcttgattgacagatggattcctctgttttatgttttattgtttttgaagaaaggaactttgatttcctgccagggagctttcataaaaggaccttagcatgctgagccctgattaaacatcagggagacatgatgattcttttgtatagctctcccctcaaaggtgaagaggcctaaattacagtgactgtaagagaggtatctgctgaaggaccatgttcagctataggaaaaattggccgtggcatagacagcagtaagattgggatgcgaatgtaattttcctctatcttatgaatatttaaagaaaatttgtagaagcaagggccatattgctactttatttatttatttatttattatttttgagatggagtctaactttgtttcccaggctggagtgcagtggcacaatctcggctcactgcaacctctgcctcctgggttcaagtgaatctcctgcctcagtctccggagtagctgggattacaggcacccgcaaccatagccagatactttttttttgtatttttagtagagacaggttttcaccatttggtcagattggtcttgaactcctgacgtcaagtaatacatccgccttggcctcccaaattgctgggattataggtgtgagccaccatgcccagcccataatgctactttagagaagagaatatccggttaagctagagagtgatatagagaatttacccacataactgaaaactttttataagataaaatagaatttaatttttatttttttttaaggatcctgctaattttagcagattttatttatgccacatgacaagtgtttgtgtaattaaacagctcactttgttctgagtttactatgtttgcttcccaatcttttattgtggaagtcctacttattaaccctgccttcccaaatcagttatgaagataaaggtgtaaactaaaaaacaaagctggtttatgagcaaggttgagtaccagaaggaatggagttccctaaattataagagtttaatctccagttttaatccgtagatgtaccctgactgccacttattagtcacgtggccttgggcaaggttttaactactctgaatctcagtaaaagtatataaatgagataataatatttacccggaagaggggttgtgacaactcagtaagataaagtgcataaagggccgagcatgctctggattttatggcattgcgtgtggcgacagtattgtaatgtaatgacttaaaaataaaactaaccaaggagattctaatcgatgattggatcattgtgctccctgttaggccaagagataaaaataaattactagagaatttttgggtcaatggcaattcttcttttagcaagtataagatgaatatgatcatatatcctttacttacttttggcttgacacaaaacatatgcctaagctgatcaagaattgcttagaaagtaaacgccaaattattttttctgtttctctttttttcttgccttcataaactgaattattaatatcctatctgctgtaatttttattttctgtgtaaaggagaatggtcgtagtctaaatatccacctctgagaacttaaaggtgggtcaaatgttctaaaattacaacacctttgctaaaatgtcaattctgactattaaaagtgaatattaactatgttgagatcaacttaatatgctaaaaatgaactatatttgggttgctattaattaatgagaaatagaacaaattaagttcaagaacattaaaaatctacccaactttacatatttatttacttagtcattatttatttattttaaatgatagactttgtgtcttcgatttacaaaaaaattgattgggaagttcagaggttccataaactccctctcacccttgcctttagtttcccctaattaacgtcttgcattgataatactgtaaaccaaaaacaaaattctaagcccctcaactgactgatggaccccctcttggccatgagtattccaaagtaaacttgaaaagggagttcaagccaggatgcgaagaggggtccagtgtgcctcattatactctcctctctttggaactcagacacaactgatcagcattaaagttaaaacagagatcttaagactgagaaaacagattccttgtagcaataagataccaaattccaacctaataataataaatctaagtgacttttattataaataataaattggtttttacatatggattcatagttgtcaccaaatcaatacatctttacaagtaaatcacagcttgggttcaaacagattcaactgcaaatcttaaagaaatatattgacctcataataagctaaactgtacttattctcacttaaccactttgtgaaacagtttatctgctggttatttttaaaggaagtaacatattatgtagcatctacagtttaatgatgtacattctagagcatttgtccttaaccccagcagcaggttaccaccacttggaaagctttttaccagaatatccagagcctgtctcccctgcagggattctgattgaaagagtcactccacctccctcctctttctcaggtagtgcggagtttccccaggtgattgcaatgtagacccagcattaggaccaactacatttgggtcttaaaaacctcaaaactgattgaagccaagagatattaaaacaaattatttgaaatagctgtataaaaatccatcataaagaattgagtgctttattttaaaacataaaagctcatggcttatcaaatattgttcccaaattataaaaacatgaagcaaatataggaataacatgaaactgccctccctgccctacccttatgggtacatgggtacattccatgcagtagcaaaaatgtataaatatcctaaatgtccaccaatagagaagtgattgaataggtgtcatgtataatcataataagagccgtaatagtattttaaaaggtttaaattttaaatatatctctatgtactgaaatgaattataaacattatcagttagaaagtaataagacaagttaaagaacaatttttttttgagagtttagctctgtcaccaggctggagtgaagtggaatgatcatggctcactgcaacctggccctccagggcccaagtgatcctcccacctgagccttccaagtagctggggccacagtcacacactaccatgcctagctaatttttaaatttatttgatttgtagagacaaagtcttgctatgttgcccagtctgtcttgaacttctgggcacgcgcagttctcccaccttgacctcccaaagtgttgggattacaggtgtgagccaccacagggctgagtcacttttttttaaattgacttttctgtcaagcagagtggcctacgtcatgacatggaaaatttagtcaattatggtgaacaacctaataaatatttaattttgtgtgcagacaacctccctctccatctgttcttctcctcctcaatgtttctaaaatccctgcaataccaatctaacaaaagttggattcctctcaaatggaccttgatcatgtgcctaagaattaaaacataataatcctttgagaaacatctatgaaagatgcagtatgaaatgttgagaagtgagtttgtagcttccataccatgcttcggttgaatttcatttccaaatacccagcggccgttttgcatggtgtagctgggctatggagcccaggctcctcatgatgggttgggtgactgaaacacatttttttcttttaggtgataaccagctccttcatcaggcttctctttcccaagtttaggaagaagttgactacaatgtatttccctagcatgcctgttcccttgaacaaaggcaggttcaggagtgtagtgaagctccaggctccaaaaactctttcactctcattgcactctatccaatgtttcttaatgctaggcacagcagaatcacctcagtttattcctcaaaaatgatggttgaatttatctggccaggcattggtagtttacagaagtctaccagatgattctaatgtgtggtcaagactgagaactatgtgtttaattgggttcatttcaagaatactgtaaaaattttatctaaatactaaatatccataaaagaaacctcggtaatcaggccaggtttttgagtttttccagattagcccaactacaggggaaagagactttcgcactatatcccagagtctctgctcctgcttccagcctcaatgcactgggcctttctgctgccttggagcacttagagggattacaggaggagtgatctgtggagttttatctgctgtagacaggacctctcagtgatgcatgcagtcactgcccagggtgcagctggggaagtcacataccgtttcaactcaaactggtacactgcaattcagttctcataaccatctggagttagtgcagaccccataagttaaagagtatggtctccagcaagatggtcctcgcttcatactcagaggctgcaaatccctgagcttcccatgacgttcctgaagctcaaaaattcactagaatgacacagaattcaggaaagcattatacttacagttttattgtagaagatacaactcaggagcagctgaatgaagagacacacagggcagtttctgagagggtctcaaacagagcttttgtgctctcttcttgtagaataagggcttgtcactattacctggaaaaaaaaaaaaagaaaaaggaaacaaaaagacaaaaaacttggttcatttgcctggcaagtaacaaacgactctccaggagaacataggttttgatctataggagttttattacttgtcccaaggtaggagaacaccgggaatattctccaaagcagtgtctccccgaggaaaagtgacaggtgggttttatggagttgtggagaggggagaaggtgcatcatcgcatgtagaggaggggcaccagtggtgcagactgagacattatgccagcacataggttacatgttatggtgatgaatctgtagctcctcccagcgtagagactttagcatggtaatgaggaagcttcactcagattcatctataagttgctggggtctgtctggaactggttccagctgactaggtgactgcattccatggacggtttgtaaaaaacaggctgaaaagtgggaggctataaaacaggctgattgttcaagctggttaaacttctatagtccctggagaccctccctgtctgcttacatcactttcctggcacattgatgtattcaccaagcgggaagtttcagcaaacttccctgttcattacatagatgtaattgattaaacattggccccattattgaactcaagctccaactccctcacttttctggaggtcaggctggttcagagctttaactctctaattacatgttaggtctttctgttgaccagcttccattctcagtcatctcatctcatgagcataaactcaaaagtttgatccaagggatcatgaatatcaaagactcttctattacctgggaaattccaaggatatagattctgtcttccaggaaccaggttcaaaggccagttaaattctttattatgcaacaaaagatttccctgaaaccagacttagaagtcttgaaagagatgggggattcaatttccacacaatccctgggctctagaacaaaggctgtcatcactgtcctcccctggtccaccattttgggttgtggtccctctctctccttgggaactttttcaagaatcagtattcagtcttccaggggctcttcattttacttctataccttgagatttatcacctgacggtgcctattcttggatttccacacccacactctttttactattcattctctaaaagcccaactaaacaaaacacaatcagatgaacctcatcgttcccccttttcccaatagtacttaattgcccattaacaggagatgaagtttcggaagatactcactcccattcttagagagaaggaagtgtttattctgcatgcacttttaagaaaccaggcagaaagcttttttgtttcattgttcaggagagattatgactaaaaacaatgccattacatctcccattaaaaagagtctgaactctgggcaattcaggataaggcacgtgtataagccattcttgtgttgctataaagaaatacctgagactggctaatttataaataaaagagacttaattggctcatagttctgcaggttttatagaaagctggatgctgatatctcttggcttctgtggaggtctcaggaagctaacagtcatggtggaaggaggtgaagcaggagcaaacacgtcagatggtgaaagcaggagagagagattgagagagaggagagagagagagaggagagagagattgagagaaagagagagagagagagattgagagagaggagagagaggagagagagagagagaggaagtgccatacactttttaatgaccagatcttgtgagaactcacgtcatgaagacagcaccaagccatgagtgacccacctccatgatccacacacctccaccaggttctgccccccagcattggggatttcaattctacatgaggtttagctggggacaaatatcccaactatatcagcatgtaatctactgcttgacataggtaagaagtaattcttcacaattatttcaaaaccatttctgaatttactttggaatctaaagttaatttggaacaatatattttatcaaattagctccaaagcgatatttactcatgcatcatccctctgaaatgtactctgcaggttgtatgttgtacaatcttaagtatttcaattacctttaagcaaaaacagtacaagaaaggattagtcattgctgaaaatattatagatcacatagattcatttccagttttcagtgttgttttttaagatagtaggtgtttgatagcttctagtcaccgtccaaagggtcatggtctttctgatctttttgttcagaaatttgttctttctggtcaggcacggtggctcatgcctgtaatcccagcactttgggaggccaaggcgggtgaatcacaaggtgaggagttcaagaccagcctggccaagatggtgaaaccccatctctactaaaagtacaagaaagttagccaggcgtgatggtgggcacctgtaatcccagctacttgggaggctgaggcagagaattgcttgaacccgggaggcagaggttgcagtgagctgagatcgtgccactgcactccagcctgggcaacagagcaacgctccatctcaaaaaaaaaaaaaaaaaagaaaagaaaaaaagaaatttgttctttctgatcacatatgactcaggatataatgaaagaggatcaagcctctaagaagggtggactgaagctagcacaacaatatgcctgctatatgaccatggcagacttcttcctagaatccttcagatccacgatcttatctaattatgtataattcccacagcagctctgcaagatagatacttatgtcccaattttgtagatcagaaaattgaagttaaggagatatgttcattaatgaataagatggtaagtagtagacataggattcaattattattattattttattattatactttaagttttagggtacatgtgcacatcgtgcaggtttgttacatatgtgtatacatgtgccatgttggtgtgttgcacccattaactcatcatttagcattaggtatatcacttaatgctagggattcaattattttgataattcaagtttcttccaaagtgtcctatgagtaattgtttctacggtactctatacaacatatactttcaggcacctcttctcagttggtaagtttgtaaagtgttttcctgattggtacaagatgaaagtgtatgcccagcaggttattaaaggtaagctaactataagagtcattcattcagtatattttttatagagtagcctgtatttctgctacaaatgatgttggcatatatgaattacactcattgttttttctatttaataaacactgaattatgttattctacaataatggcatggtgaagatggttaaaagtagtgacagaaaaatttgactttttagaagcctctaatttgtgaaattaaaggaatgatttcttctaccatgaggtcatagatattgaaaaccatttggatattgtttaaaccagtttaattttatataatttatttcatgagctttcaagtccgtatctccaatgatcataccagacagatccccaattcagaagttatcttgcctctgacagtgcttacaacaactaataaccaggttcaatgacagtgatccagtttcggcaggtactataattgcagattatactgttcatggtttcttctttgtgtgaatagtaagtgtatgaaatcttcagtcaacatttccttttctgttgcataaacagtgctgaaagcttaatgatcagctggagaagaggcgtaatgaatagttgcagcattgttcattaaacaccgtggtggttctttctttgccatcatttcatctgtgcttgaattttgcatttccttctattctgtcattctccttaagcatcggacactccctccgtggtaattgctgtgacacacataaagcttctatcatacaacaatggaaatgtctctccttctccttgagctcattttattggagacactgtacttttgaggatggcaaatctatggaaagtgactcatccaagcatactgtaatagatggagagatttctttagatatatgtggccttttgtacaattaagcactgtattgcttttcagtaaattaagagtaaaattttaagtaaattgggtttggaattgggatttgcaattttttgctataatttattttagatcacctattacttttttggtaattttgtttctactcttacataccttgtgttctacatattgacaaatcatgctctatttgatgaattacatctttaagttattggtatgttactataggtaatgtttttgtatcatcttcagtagcctgttagcatattatgacaacatgctattcctatctccccagggccaagcctcaattaactgctgacactaagaggccttcactccagaagtagattccaaaacacatgttgcaatgaatagaactactttgtatttcacccaaaacatttaagccatggctgtttattacattgtgttattttattcatggattaaagctttggaatttggtaaaggaaaagattcccagagactgctattgaaatttcctagtaccctttggtttaaagtgtagaggaacaattttccagataaatatggaattcgcttttttatgttgttctttagagagctttagcctatttggcactaagtataattatctgcaaatatgagtttgtttggcaagatattcatgtgtccttaggtattaatatgtcattttggggaaaaaataactcaatggagttctgtcattatatgaataatttgtgatgagtaatttcctaagcaacatcagaagcaccagatgacgatttttgtttttagtttgcaaaatgcatttattgtataaggatgaaaggtaagtaaggaaaagataggttttagtagctgagaaactttagagtcaggttatacttaggtggatttaattgccatactttgttatagtggctaaagtagcccatttgtcatctgtgacctatttcagggaacaacaacaacaacaacaacaaagaaactgtggataacatcaccccctccccacctttgttgttcttcttgatgcctatttgacagaaggattgagcactttctgtttctgttgcatgggccactctctctgagacttctcccacagtattcatatccctgcttcaggaccacctcctctgaggagccttcctgaccaacctgtataaccctttgttacacaaccctttgttcctccttggagtcactttcactgtccagcttctcaatttacccagctttttttcattatacttttcagtgcctgaacacacacacacacacacacacacacacacacacacacacacacacacagtttcctgtgttaaaatggttaaaatgtcagctctctggggggaaggaactggtttgtcttacccagtgttatgtccccaattgcacagcagtggcgtgtttcagttatggtcctgcctgtgttcaccatgtaagtgggcagacatgatagaaggagatctattatacttccttgtgttatgtgcctatggaatagagggaacagtggagaaagtgaataattatacctgggacctggggaaaaaactgaaatgagaactgacatgttaatatatgtcaaaagattgagaagaggctggggagaaatataagaaaggagaatttcactcggagtaacttggataaaatctctgagtttgaaaagagtatggaacattcaagaaacagtgaaccaaactgtgattggagttctattcccaacagttgcataagggaaactgaaatgaggtgggtctggagaggtagcttagaattaggttttgaaggagtctctgtaggttactaagcatgatcagcttggtgttttatgactgtattctgataactgtgaaagatggatgggagggaagcaggaaaggggtcaggaagtagacagtgtaagtgaggatggttgtgtgtacagaagtgagtgggagaaccacagatggctcacaagagaacatgtgagagagaccctgtgtcagctacagtttgtattagttggttgattagggatattattttggttttgctccgtaaggtggttggggccgaagctctttctaactcaccaccctgctatagtcagggtatgggccttgctgtcatggtccaaaatggtgattagtgctttaccctccacatctgttctaggcagcatgagggtagggtccaaaagatgaggggaggggaagccatgtgtaaattgtgtttaaaaaattattataaaaaacacataaaaaattaatcatcatgtcatgtgtacagtacactaatgttgactctatgcacattgttgtgcaacagatctctacaacttttccatcttttgcagaactgaacctcagttccctttgaaaagttagactactttagataactcacaaacatgaaatcgtgaaacatttgtctttctgtggctggcttatttcgcttcacataatgtcctcaaggttcatccatgttgtagcatataacaggattttcttcttttttaaggctgaacgaattctattgtatgcatagaaaacgtgttctttaaccattcatccacggatggacatttaggttgcttccacctcttggctattgtgagtaatgctgcagtgaacatgggtgtgcaaatgtctccttgaggtcctgttttcagttcttttgaatatatactcaggaatgggatagctagaggatatgggtaatttatttattttttttgaagaacctccgtatgtttccatagcagctacaccattttacattcacaacagtgcacaagggttccaatttctccacattcttaccaacatttattattattattatttttaataatggccatgatatctcattgtggttttgatttgcatttctctaaagattagtgatgttgataatcttttaatatgcttgtgggccatttggatatcttctttggaaaggtatttattcaagttgtttgcacattttttatggagttattttgttgttgttgagttgtaggagttctttatatgttctggatattaaccctttattagatatatgatttgcaaatatcttctctcatcctctaggttgcctttcactgtgttgactgctttcctgtgcagaagttttcaagtttgatgtaatcccatttgtctgttttactattgctgcctgtgcttttggtgtgatagccaagaaatatcgccaaatctaatgttataaagcttctcccctgattcatccagtagttttatagtttctgggcttatgttaaagaccttaacccatttttaactaatttttatatatgatgtaaggctagagtccaactttgttcttttccatgtgggtatccagttttcctgataccatttgttgaagagacagtcctttccctgttgtgtagtcttgacactcttgttgaatatcatttggtcataagacctgagagtttatttctgggctgtttcattctactgctctgtatgtctttctttatgccagtactgttttgattagtgtagcctggtaatatgttttgaaatcaggaatcatgaggcttgcagctttgcttttctttctttgttttggctattcaggattcttttagatgtcataagaattttgaaattaaaaaaaaaatttctgcaaaatgccatttggattttgaaagggatttcaatgaatcagatctctttgggtagtatagacattttaacaatattaagtcttacaatccatggccatgggatatcatgccatttatttgtgtgtgtgtgtgtttttttttttccagcaatgtcttatagctttcagtgtacaaatttttgcctccctggttaagtttcttttcaagtattttattctccttgatgatattgtaaatggaattgttttcttaattttcttttttgtttgttcattgttagtgtgtagaaacacagacaattttttaatgttgattttgtacgctgcaactttgctgaattcgtttatgagttctgacagtgtgtgtgtgtgtgtgtgtgtgcatgcatgcatgcatgcaaaaattttaaggttttctacttataaaatcatgccatctgtgaacagagatcatttcacttcttccttttcacctgttggtgccttttagttgtttttcttgtctaattgctctggttaggacttccagtactatgctgaatagaagtggtgagagtgggtatccttgccttcttcctgatcataggggaaaagctttgaattttttcttgttgagtataatgttaactgtgaaattttcatatatagcctttaatatgctgggtaattttcttctattcctagtttgttgagcgtttttatcatgaaagggtacttaattttgtcaaattcttttactgtatccattgaggtgaccatgagattcattgtcctttattttactaatgtagcatatcccattgattgatttttcatatgttgaaccatccttgcatcccaaggatagacctcatttggtaatggtgtgtaatctttttaatgtgctgttgaattcagtttgctagtatttttttagggattttgaggatttttgcatcaatatttatcatagatattggtctatagttttattttatggtagtttctttgtcttgttttggtattagggtaaaaatggcctcataaagtaagtttgaatgtttcctcttcaagtttttagaagagtttgggaaaggctggtgttaattcttccttcagtgtttgccagaattctccagtgatgctgtttagtcttgggcttttgttgttgttgttaggagatttttttattactcattcaataatcttactagttatagagctgttcagattttcatattttcatgttcagtcttggtaagttgtatgtttctaggaatttatcactttcttctaggtttccccgttgctggtgtatgattagttatagcaatatcttattcatctcattatttctgtggcatcagttgtaatgcctcctctttcatttctggtttttgttatttgagtcttctctcttttttcttagtctagctaagggtgtgtcacttttgttgatcttattaaaaaaaaaaaacccaaatcttactcttgttgattttttcctattgtgtttctagtctctatttcatttatttctgctatgatctttattattttttcattctgctaactttgagtctagtttttcttcttctttttccagttccttgatgtataaagtcatgttgttgatttgattttttttatagaaatataggcattttactgttacaaacttcttttatattaatgcctttgctatatcccatggattttggtatgctgtgttttcattgtaatttgtctcaagatactttctaagttcttttatgatttatttttgactcattcattgttcaagaatgtattattttcatctatttgtgaattttccagttttccttttgctgtcgatttctagttttattacattatagtcagaaaaagatgcttaatattagttcagtcttcttaaatgtgttaagacttgttttgtgctataggatatgatttatcttggagagtgttttgcatatgcttgagaagaatgtgtattctgctcttattctgtggagacctctgtatatgtctcttgggtccagttggtttgcagtgttgttcacatcctttgtttccttatttatcttctctctgattattaatgagttgtcttttttgttttttagagtcagtttcactctatttcccaggctggggtacaatacataatcatagctcaatgcagccttgaactgctaggctcaaactatcctcctgccttagcctcctaggtagctgggactataagtgtatgccactatgctcagctgatggtttatttttatttttattttttgaggagatgggggtctcattatgttgtgcaggctcctagtcttgaactcctagcctcaagcaattctctcaccttggcctacatgagttgtcttttaaggagtgtttgcagaagctctttgcagtacattggctgaatctcattagctctctttggtcatgcttacatgcaaaaaggctggaaaatgtagtccaattccaggtatcgtgcacctctaaaaataaggattatattcagaaaaagtgaagaatagataatggggagcagactgcattgggtctaacatattagatcagaatctaatatttttaaggtaccgaatgtatatcctatcacatcttgatttggatgaggcttttcattttatagatggaggaaactctgaagccttcccttgtgtgtctgtgatatatgagcttttaacttctcatttatgaagttacaatagatatataattcttaccttattgtgtgttctctaagaagcacagtaaaaataaaatgaagctttaaaagtttaaaatgatactgcagggaattcaagatgaaaaagatatacaatgccaaattacttccacccatgttgttacataccctattaacagcatgcacaagagacaattctatttctagattttagcaccccatttcataatttttacttgtgacgaccagagaatatgaagtaggaagatggcctgtggggagatattatgcatttttgttattgaatctcaccactaaaaattgtgtttagtaatcacttctccatcacctaaaaattggtaacaggtaaaattgaaacaaatttcagtaagataattttgtcattgggtacctcacttgaaatgtgcatttctgagtggagaggaagatggatgattctaggcaatttatactaatttctacgtgtgcatctattaatttttgaagaaatactgttagcgaaaactgtaaatgtataaagtggttctgatcacagtggaggaatggaataaaaattaaattgaaagcctctcatgtcaggctaagagatcgttttaaaatcatcatgcttatttacaaaagctctgtgaaactggtctaagttaaagaagaaagaaaatgagttttagattagaagtgagttatggcccctgcttttcctagcagtatgtccagtttattcacagtgttctccgcagttctggggcattctggggaaatctgttcaggaataacccatgatatcttcttggggcttggagagagtggtaaacagacatactgtgggtcaaactttgggatatccatcctctttcaaccacagagttagacattgatttttacatattgaacttctgcattagcatttccctggaaaaataagtagttctgaggcaaaagaaacaaaccattggactaaatcatgctgcttttatctctcctccaacagaagactacattttagaagtcattttatcaaactttagatcttctcatccttttccttcccaccacctctttgtaggcctaaaatttcatgagttattcctatactttaaaatatatgcttggtaaaggaagatttatctttgagcaaatgaataattcagaggctagaatttccctgagattagtttacaaagtgaagactccaacccagaattcaaatttctagggcagaaaagatgtttgtgctgtttcctccacataacagaaatgcgactgcgttttagtgctcattgtgaacacgttcttggaaaaaagaggtggaatgcaagtcccagcagaataggcacattgtatatgacagatgctacccgctttctgaaaagactcatagtcctcagtttttgatgtaagtaggactcattacatcaaatctctctttaagttttaaataaacataaagttgtttccaaaataatacaccccctctataattaggtggagaaaacaactgttatcagccgttgactacacaagatctatatcagtccttgatgccttccttgaaaattccatttttcttatacatgctttggattatcttaaaattagctagatttgttttacattgtgaagataaagatttctcaagtttcccaactctgttgagtcaacattgagccccttatctttcctcaattcactgatctagctgcaatttctcatgcaatttccaattttgtttatgccgtttgaggacctcacatataccaggtggactttcacattatactaacacataaggactacgaggacagcaataactgtatccagatagccaatgaatagtgaattcagctatgatataattatcaaaatataaatgtacaagtgattctttgattagtcttttgaggattaataacgaaagaacctagaaacattaatattaatcacattagtttttagaacattaaagttagagtcttctaaataagaacattttctaccggccagtttgtgttttctccctataacctctatttttgtgtcacataatttaccttatcacatggacatattttacactttacatctcttatttatttaaattacacaagtagtagttgcattaattgctgggcatggtggctcatgcctgtaatcctagcaactctggaggctgaggcaggaggattgcttgagagctcaagactagcctggacaacatagaaagaccatgtttctacaaacatgaaaaaaatagccaggtatggtgacacatgtctgtagtttcagttactcaggaggctgaggcaggaggactacttgtgcccaggactttgaggctgcagtgggctgtgatcttgccattgcactccatcctgggctactcttaaaaaataataataatttgacgcattaagtttttgggttgtatgtgccatctttaacaattcaggcttcccccttactaatcttgtggaaagcatctcctgaaataatctcttccaatttccgactaaaatggcattgaagagagaaaaagatgaaatcttgcaacttccatcccatttccattgcataccagcaggcagcctactgcctggatctgaaaggggatcaatgtaaagatactctgcctagattgtgaataaagcagaagtgacttaactttcataagacccataaagtagaccagtcacactgccccaagaaaggaagaaaaacatttcaggccattgttgtttgctgctggcctctgaggccaaaggcttcatcagctagaaaacaatgtatctcttaccattacaatcgtggtgctttatactgtagttaaggtacattcttccactgatgatttttttcttacatttactcacagcttccacctccaagaggaaagtggggggtgctctgaggaagcatgggaactacagatgacttaccacattgtgacaagtgtagtctccacagttttggggctgtgacagcaagaacgtgattgcaggtgcaggtgtgctgagatggttatgctccagtactgagagccataggacaggagagggaaggagaagcttctacccccgtttaacagagccacagtggatgagtgatttctgttcaccagacacgcctgtgacatctacctgtttttaacttcagacctgagaaggtgatttaacagtcactcaaatggcaagtaagcagacaaaaagaaatccacatggcatgcccaagggcaagcgtcagaagagacaacatagagctcataatatacaaagagcagcagtgcattatcaacctaaatgtttacagaaagagtatgcttctgatataccaacgataaactaaaataaaattttagaaagtcattgtatagctacaagagagttttaaaaattgcataatatgcagtgtctcaagaaatatgtcaccataacctttacttgaaagactaaaagaaaacttaatttgattttcagaaaaagagtggtgaataaaagtgttttaaaaactgaaaaattttagtatacatggggaaaatgttgtttgaaatggttaaacttaaagatattggttagaaatgtgattataaaactaaatgattggtataggttagtaagtgtcagggaaaggaaagtaaacaaaaggcaatgatatgcctcatcttttgtggcaggagtcaaaagatgcaattcatgctgaacctacataggctgaaaaacaaggctgatcttccgtgagtcagagggagtcaatttgaattataggatgaatgaaacttctacgtatcctgagctctaagtcacagatggaaattatcccttccagtaaagcacccatggcacattttcaaaaactggaaatctgtttaccacaagtactgtgatataaaggcaaaatccctcagtctggcatgatctagacctctggggtgtgacttatttttgcattttaaccctcaaccaccacttcccagcaccaaccatagttccatccagattccactgcccctgagctctaatggtgcccacccctgggatgatctcatttctacctcccccagacctccttccacatcctctgcagagaggccttttgtggctcacctacttctcagggctctttctcttcctgaatccttgttctggtcattgtctgaatatctcacttgtcacaactggattggaccttattttgtccattgttttgttttttttccatgacttggtgttaattcctagaaggtctggatcgtataatctttacttttcttcttccttattctcctcactccccttcctcctccttctttttccttcttttatctccttctttctccttcctcctcttactcctcctcctccttctaagtcttcccctgcgctaggctgtagctcactgttaatgcttggttcactgaatgaatgaaaacaagaaaagttgtaagagccttaaccataacactgagttacattttgtcttcctttccttgttttaaattgcgattttgcccataaatgcattctggaaattgagtcattggcatttcatagaacacataatatctttgctctgaaaacaaaagcaatcttatacttcaaatctttataaaagtagagttaactataaggccaccttttacatcttgatacagtaggggatggtgttttgggttgaattgtgtcctttcaaccccccaaatttatatattgaagtactaactcccagcacctcagaatgtgactttatttggaaatagggtcattgcaaatgtaattagtaaagatgaggtcatactggagtgggggagaccgctatttcaacatgactggtgtctttatataaaggagaaatttgtgcacagacgtgcactcagggagaatgccatgtgaggaaggaggcagaaatgagattgatgtatctataagccaggaaacaccaaagatttgcaggaaaccaccggaagctaggagagaggcatggacagatccttcagaatctctcagaacgaacctctcagaaagaaccaaccttgctgataccttgatcttctttttctgaggcggagtcttgctttgtcgtccaggctggagtgcaatggtgcagtcttggctctctgcaacctctgcctcctgggttcaagcaattctcctgcctcagcctcctgagtagctgggattacaggcacccgccactacgcccagctaaattttgtacttttagtagagacgaggtttgaccatgttggtcaggctggtttcaaactcctgacctcaggttatctacccacctcggcctcccaaagtgctgggattacaggcatacgcccagccaataccttgatcttaaacttccagactgcagaactgtgagataagtcctgctgtttaagccacctaagttgtggttctttttaatggcaaccctaggaaactaatatagatggtggttttattaagaaaaagaaaaataaaggcactcttatatttgtatgtttatattaattgccccggaaggctcttggcagcctcagaggttttatagcccaagtatttctgcagggaaggaagggacataccacatgatgaaaggtaagtttttggttttctgtaatctgattataagaaggttgtgtatgtgagtgtgtgtctatgtgtgtgtgttttaataagaataacatgtgcagctaaagccatgggattatgctcacaggttgctacactcatacaaaaatgaaaatattttatgaatacatgagctgtccatcatgggcgtgaatctgctgattaccatagtctctcatgctccgaacagacttcttcatgaattttgagttatgcttggaaaatatcttgcagttcaacaggccaaatataaaccacgggctcttgcttaggcacgggcctggtcttgcttagtatcgccatcttccaaaacctaatctgtaactgtactagcttcctagggatgctgtgacaaagcaccacaaactgggtggcttagaacaacagaaatgtattgtctcatcattctggaggctagcaccaaggtctggagtccaggcagggtatcagcagtgccatgctgtctctgaaactataggggaaggacactttttttgtctcttccagcttctggtagcctcagccagttcttggcttgtggtagcataattccagtcttggtctctgtctattcgcagtatccaccctgagtctcttcatgccgtcttctctctatgcatgtccctctgtgtccaaatttccccttttcataagaacactgtttatgtaggattgaagcccactccagcaacctcattttaattccatcagctctctaaagacctcatttccaaataagattgcattctaaggtactagggtcaagacttcaacttatctttttggaggtacacaattcaactcacaacagtaaccaaaatgacttttcaggctggtgcccagactgcctgtcatctgacagaattttcatgtatggctgttctggttgcaaatagcagggcctcactctccccattggccttgatcccattgctcatagtggcattctgacattcttacaatttgtataacctttgtgctatctaatttgacccgaaagccccagagtaggcatgttctatgagtatgttgggtttttttttttctagcaggtaacatttccagattagccgagccaaatgatatggtaacataatagatttccacctttgcacacctgaagtgtatgacctagtctaatcactgactgtggaaacagtagctaatatgacaaaagtgccgtcggggacttcagcacttcattatcgcagggatggcttccaaagctaaccccctcagtgagaaactcaggcatcccagattccaggagttttggaatagaaccccgtatttgtattgtgttggattgataatattaagaagtttacttaacttctccctctgagtgtgtttccattttaaaaataggagtgttaatgcctcctttgcagagtagagagtgctcaacacatggtaagtgctccttgtctgaaggttgcttattccactccctaatcatagtggctacaaaagatcatccttcagactcaagtaactgaagcctgtgggcattacatattcttgtactttttcttctattgtaaaatctgcaggacacttgaaagttgttgtttatgttgtttgtgttaaaacgcttatttttttaagatgatttttagattcacaacaacattgagggaaaagcgagatttcctatacagccccttcccctactcaggcatagcctcacccattatcaacattcctcaccagagtggttcatttgacttttaataatctccaaacccttagattccagaaaaaaatgcataggttgtatagtagggaagaaggtcatagtttatatttcttgagattatacactttctctctcaaaccaacggttctggccatgtgaggattttgtcactcccagctgatttggagatcatcacttttgcaatgcaatgtggaactcttgtctgcgtttagccctttctgaggacacattctgtgttttgctagactgaggcaagttcttgtgctttttgttgaaacaggcagtgctgtacagtgggaagatgctggaggtacaaaggaaaggccaggctgtgaatcctaacactagcactcgttaggcaagcaatttcacttttaccagcttcagttttctcaaagtgtgaagttagagggcaacctataggcccatcctcatttcccacactgattgcaaatttgtgggtctaatgcaaattgcaaatatgagaatcctcaaaactagccctaggttcgataatgcactaggaagaactcatagaatgtgctgaatgctgtaatactcacaggtacagtttattacagggaagtgttgcaggttaaaatcagccaagggtaaagggacatggggcagggtccaagaacatttccttgtggagcttctagttgtcctctccccagggagtatggacaactttacttttctggcaaaaacatgtgacaatacacatagggtattgtcaaccagagaagttcagtcaagccctggggtacagagattttactggggctccatcacattgacatagtcgaccacccacatggcagatctcaggctcctgtctctgagaaggctgagctgataccacatggctcaaagctctcaggctgaatcatactgttaggctcttcagtgtgacccaaggccctcaggtaaacaaagacgctcttattacatatgagaatcataagaaattacctccaggaagtcaaggactaaggccgtacctcttttggggcaaggttaataaattctttactacacacatagatagaacaagtgggtaatccttagcgacctgtctagtctgtaaaatctacagtgatgcaaatgtgcagccctgcttaagggcatagccaccgtcaccttgtttaggaactgtcagatctgccctctcatggccagatggctgcatcagcccactggtactctctgtgtgatatgcccgagggtttagggatgtttcagaaggctagttgtatctggcaaatgggtaactcttaattattgtatgacatttttttctgtatttaatggttaagatttagggaaggggcaatatgtgaaaaaaacacgttatgagaatgtttcacatttagaccttgagaaattggtatttatttatgccagttacctatgtctctgaggtgccaagaggatgaattaatattttatttcacttgtggagatattcagaaacattaaagtccttggtcctcatgagaaaagaattttcttgagacttgaaagcattactgcagacattttgctaacacattttttgtgagctgtgttaattgcacctacctttatcagtcagaagttttgctgatttaaatcagatcccagctaacccaagcggggctgcactgaaggccacatctctattgcccagatttcccaggggactctggaaattaaccagaagccctcctgctcgaagaccaactcttgaggcgtatatgatttgcatagaggttccaatgtgccaagttcttagaagtttctgggagccatacagatgattactattccaaatgttctcatcttgggttccaccctttttattcaatgagatttgacttttctactttttcactcccatcttcaccacaccaaaattcatatctaacagtcattgtgtatattatgaaagttggtctcaatttagtcaaacctgggtttcaggggatatagctcacataaaaaggaatgggaggtatcattatatggaaatacctgctgtgtgccagagcatcctttaaggtattttgttttctgtgatattttcaaaccctccactttacagatgaggaaagtcaggcccagagaggtcaagaaaatcacttcaggccaaacaaggtcacatggaaaagtagggattcctgtgaactcaccctgtgttcttcctactccttcatgctgcagaaactctccctgaatccaaatgatgccgctgctgaagtgtgggctggttagagtgcatcacacagagccaagcctcattgtacgggaaggtaaactgctgccttcagatggattttgtgtatctatggatatcatcagttgcccagcatttctgtgttatctgagaagtatttcattgtattactggcatgttcatggtgaataaaatggcaaaagtgttattaaattatattctttgctgtcccccaacacagctataaaaggcaacgctttatggaaagaatgatacattcaaaattcagtattcatcttttgctaacattttcctggtttgtgtgtgtttttatttgaatacatattattagtcaatgtagccataaactgaaaacctttgtgtttgaatttttgtaaattgcaatcttgcccttgagaaaaaaaaaatttaaaaatgctatttatgcttgttactactaattagggtggacacaaaacaatcgaatatctggatttgaccattggagggttacagattggttagaacatcagcatttatcatatttagatgactgattcatttgcagccagtcatgtggctgctgaaattttcccttaagtcaacgtttctgatctccatatgtaggagagtcgtaccaccgttcaaattggcattgatcaggaagggccaagagaattttcttcttctctttctgaagtggttttctcaggcaggactgagagaagcttcaacagttgaacagctgttgtctgtcctttttcctctctgtaaaatatttcctgatttgcactgatttcccttcctgagacttgaaacagcaaaacagaaacaaattaggtgtgtatcaggaatgaaatacctcctgtttattgagagtttaataataatctttgcaattagcgtttgacatcctggaaactcctactgctgagcttatacacacacacagaattttcaaacccaatgtggccaacacccccacagacacctggagaattcaactgctcctagaaaaagtggattggaattattttattcctttgcaaactttttgttgatctctaacctattggggtccaagcatgaaatggctctgttgtattcaacttctgacacttaccctccttaaattggtcaggaagccccttttgtgacgtcttggataaattttaaaactttttgttacagttgcttattttaagtcatgccaggtcagcaatcccattactgggtatatacccaaaggattataaatcatgctgctataaagacacatgcacacatatgtttactgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctccctcacaggtgggaattgaacatcacacaccggggcctgttgtggggtgggggaaggggggagggatagcattaggagatatacctaatgttaaatgacgagttactgggtgcagcacaccaacgtggcacatgtatgcatatgtaactaacctgcacgttgtgcacatgtaccctaaaacttaaagtataataataataaagagtcatgccacttattatgccttagtccggtccactaaaacaaacacaaagtttagttcttccttttcctttcctcaacctgaccaaatttgtggtgatttcacttatactattgaagtgtgcttgtgtgtgtgtgtatgtgtgcgtgtgagagagagggaggggagagagaaagaaggcggcaggggggtgcggagagagagagagacctcttttttaccccatgagtagagtaaggagaaagtagaagaaaacaggcatctccctgcttatgcaagacttgtttcagataactggtcacccaaatggtggtctcagcctcagaagttggcaccccagttagttcattcctgggtttttttgtttttcagtgacacagggcacttttttctacctgtgttggagtagagtgtcacaataatagctgaatggagccttgaactcctggcttaagcgatccttccacctcagcctcctgagtacttgggactaaaggtgtgcataccctgcctggctatttttttttaaatttttatttttgtagagaagagatcttgctatgttgcccagggtggtctaaaactcctggtctcaagtgatcctcctgacttgggattacaggcatgatgcaccacgcttggcctcaatcctgtttaactgacctcattggacacttggccgttaacttctggctggccaggctaatgcttctctgagctgtttgtctctctggcctcatctgcagcaggccctgcaagttggtcacctgcaatttcatctgccatccatagcactgactctggatcttgacaggggacttaggggctcacatttattttctcccctcctcttgcctgtactgccaggtcatttctctctaacactcttcctgaattccagtagcaaaggtctgtgatcctgtggctaggtagatacccacaatagaactagctgtttgtctccattcttgaagatcctcccaaacttcacaagtctgttggttgagagccccatcctttgcttgggatgagaaacctatggagaggggtatgccccttgaggtgatttctgtttgtctttccatccttctcttgatggctattatctcagtggaaatagacctaacaccccagagaatcttataacttggttctcagcagggctctgtctttcctgtaattactgtgtatttgattatctctggggctctgaaaagacctcagtctgtaccttccagtccattctgatacattcttgtgaatcaccaagtccatctctttttctatgttggttagtaacccaagaaaataggagattgataaagtatcacattacagaacatttaaatagtatcatagactccattgcctttcttcccagaatgtgagtcattgcctttgtgatgttatgacatagtttatagcaaacataaaatggcactgtttaattctgctctagtggtcatcaggatctgaaaataaaacatatcaccagagtttttgatgactccagtctcaaattttcagtttctttgatttttctaaaatgaaagcagaactttttcatcctgtctttgtttatggcttatgttgtctaagcaggaagatactgactcattaacatctcaacatttttggtagaactgtaaagagcttttcaactttttaatctgaatattgggaagtcagatatattgaattagacttaaaattgggtagtgattattgttcatttcagtattttccaatcaagctgacagttatgaaattctaaatcaatatatttgctttatcttttatatctttaaaaatagttaggcaggtatacaagagttggggtatttctatatatttaaatatttttaaaaataaagcatggaacattttgaattcattgtggatgagggggctgatgagagttgaggtggtaagagcagagttaatttaggaagcagccctgttgtggatgggaaatgtttgctgctaatgtctatttttctgtgctggagctgacagaaatttcctttttgtttatcactttgagccttttgaatactggcagtcatgacacttatgaaaatgtatactatatagttaatgtccttttttaatctcatggaagtgaagttattttctttctttgattgcatgcaatggatgcttctaaaaatcactctctagtgattcaaatattagattaacataccagtttgctgagtaaattctctgaactctatcagaacaaagaagaaactacaagaaaacaagctgaactcaagagcttgctttctctctctctctattttttcttttggaccccacaatttccagctatgtcttagggaatcagctccaaatcagtctgctgctaaaatgatcattgtgtacacccagaataaaacataaaaatatctgcattcacaaaaggaggggtgggtgtgaatgagggcattctaaaaaagggtttaggcattgtagacatttgttctagacaggttgttaaaaatcaacatgaatgccaaaatccaggaaaagaggaaagagcacttcacaagcagtcctgctcatatcaccttgcctgtgtcacaccagccactgctgcactgtaaccactagcagttttaagggcctcactttcacctaggattttgcatagcattgactgtcttgatatgatttcacatgttatttatgtcaggattcagattactgaactggcatgagttgtgctcatgaaaaaatataactaaagtctgtattagtgttcttcagagaaacaacatatatgtatgttctgttacattatatatatatgtagatacagatatatacctgttataaaatatatgtttgttctgttatattagacatatacctgttatataatatatatgttatatagaatatataatatatataatactatatatattatatatatatacacacacacatacagagagtgagagattttatcataaggaatttgttcaagcaattgtggaagctggatctggttaagtccaaagtatgaagacccctatttcccagttgaaatctgagggctggaagctctgtagaacaggagctgatgtcccagtttgaaggccatcagacaggaggagctgatgttcctctgggaggccaagttgtgcaccacttttgcagaaataccagtggccatttattttagttctgcatttcatagccttgtcaatgatgaggactgattgggatctgtatccagctaagggtgattatgagaattcaatcaaatgtcctgtcaatcttgacctgtggcaaatgggcttaaaaatcatgttcactagatttcattacagcatcttattctttaaatatattcaagtacctacttagtagctgaagaacaggctggaaagtgaaaatcacagcaaaataaaagttgatacctttgaggaattgagtgatcctgagtgtagccctgatttatcctttttttccagctaaactttctgtttaggtgatctcatcagattcatgactttaatattctccatgctgatgataccaaaatatgtttctcagactctgacttctccaataaactctgcactcatttatccagctgctccctcagtatctccaattatgtgtaatagacaccgtaagctttttatatccagaacagaattttgagtcccttgcctagaaaaatctgatcatcacctggtgttcctcatcttaattaatgacttcatttgtcctgttgcttagatgtggcagattgtatttctccaaatgaccacagcaaagatctcatcccacgtgcttttcttacagtgtaactttggtattcatcctatgagagttggggtctgtaatctttctgcttgaaactttgtggtggcttttgactgtccccaccaatagaatacagtagacgtgatgtttggtgacttccaaagctgggacaaaaggcaaaacaacttccctctggccctcttaggagatgcttgccctggggcaagccattcaccaagctccaaggaacccacactcgccaacatggaggaaccacatggaaaggccaactcagagggacagtgagttccaggctgaagccagcatcacttgccatagatgtgaataaaccagctttaaaatcattcctacctctagcttttgagtcatttggtgatggtccatacactagggcagacatacccttaaactttgagtaatttgttatgcagctttagtgactaaaacattgcaagataatgcattagccatcctgattcctctcattcacacacccatatatcctgtaactgtactttcaaaatatagcctgcatgctgaccacttcttaactgtccaccacagctggtcctgaacaccatcacctcttgccttatttactatagatgactcctaactggtttctctgatttttccctactacagattatattttccaagtagaagccagattgattctttagaaacgttcacaagatcaagtccctattttacttaaaacctccagtaacttcctatcacatttaacatactaccaaactcctcactatcccctattaggccctgtgctacctggtgtctttttctctgaactcctttctaccactctcctccagactcacaatactcaagccacactagactcttactcttccctaaaacattaatctctgagccatagatagctaacagcagaatacatgcctgtcttccatagctgtgggattgctcctgggtctgcaatgtccagctctctttgaacccataagattaattctcaccagtaacatggtgcttcttggatagggttattaggaagcaagtgtgctgccctcactctctggatgccaaggactccatagccctaggtgatggcaaaacttgaaggtggaggcagcctaggtccctgaatcaccacatggaggaaagctgtccatcaaccaggaacgcctgcattggactgtgaatgtgaataaaacttagggtgttgttaggctactgaaattttagagctcattcattatagtacctggtatttctctacctaatagtgttattccctcctcaaagcctttatattggctactgcctgctgctcttctctcccttacatcattctctcccttgcatcatgactctgccccccatttaaaatatttaaaatagtcagtgctcccacccccacacgaatttatactttgtcatactaccctgctttatttccttcatatacttatcactgtctgaaatattcttatgtattttattttacttccgtttctagtagaatgaatactttgtaatagcagggacctggtctgtctttctgttactctattcccagcacctaggtggtgcctggcatgtaccagtgatcagcatttgcttctggataggagcaattacatcaagtagaccgagaacaggaatgaagagttgggaattagggtctttggaaattaagttagcaccacttgataaatgattcaacttctcagtgccttctcacaattgtcaaattgggataatatctattttatggaatagtctgatgattaagtaaaatttgtatgtaaactgctaagacctatagctttttaaattaatatttgttcttatttcatgcaggtttggaggggaggaaataattgccaaccttaacatttattcttctaaaataagtgagggcactgccacatttgatataagtctcatagggtggcctttccagattggagtagtcaactactaggggttgttaacacttttataatatgaaggtctgttagtcagatactttgacacatactacagcagggaattttacagccctggcaattgttttgaccatcacaccatctctaaatgatatgatagaatggccacatcctgttctgactgagccgtgcaagttctgcctttattagtttccatgtggtattgtgaattcacagtttggtggttggaggtatgtagatgacaaatctttgtttattcagatctccaggaagcaaatggtattcttttgcagagtggccaattcaggaaaaacacgtttataagctattgttatgtttttcaaattaaaaacatgaatgaaacataagagagttatattgtaatactgaaaaatattgaggaaaacatgaaattctcctctcccttcacctcttccaagtttcctgtccaagaaaaacttgaaactgtcaaggaatttagtgggtgaattttccacatagatggtattgtgcccaagggagcaaagatttgttttggggaggagtgaaaaaattttactcatatgcgtaaagtacagatatacatataacacataaacagatatacaggctgggcatggtggctcatgcctgtaatcccgccgaggtgggtggatcacctgaggtcaggagtttgagaccagcctggccaatatggtgaaatcctgtctgtactaaaaatacaaaattagctgggcatggcggtggatgcctgtaatcctagctacttgggaggctgaggcaggagaagcacttgaacccaggaggcagaggttgcagtgagccaaaaacaagccccactacactccagctggggcaacagagtgagactctgtctcaaagaaaaaaaaataacaaaaccaaaaccagatatacagtctatgtgggatattaaaatttcatggcgaggggatttcatgggagtgattaggaaataaatgtctacatttctttaggggagtgatgatgaaatgaatatttcagaaacagtggtgtagtgtttatcctcctgttgccttgtttgcacccacacacaatatatatgtataaatatttttgttgttgacttttataatcattggaatatgaataaggaagaatgttgcacagtcactgatagtcatctgatgacaggaaggggacccagcattggcttgaggcctgtgttgtagatgtcagatcagagaactcccttgtgttgtcattgtgctactgcctcaaataactgtgaaacaaatactacccccaagaattcccagtctatgaaataatacatatcctcatggtttgaaccaatttgaatcatgctttctagcacttattcccaaaaatgtcatattagaaagcaccctataccaattaacactctcatatacatttatatgtgtgctcatatatgagattctcttcagaaaaaaaaaatctatactatatttgctggattgcttactgacaatttgtatcttattacagattgtatattaatttatactgctcacttctcctttggatttgttgtggttttcttcatgcttttaggacctttttatttttcctgatgtggtctttattgttaaaatatattgcaaatatgttctccaagtcttccacttttaacttcattttttttttagagatacagaagggcttgtgaaaattatgcattctaggttgtgtcttgcttagggagaccttcccagcccaatactatgaatagtttccactaacatcctttggtaaatgcatagttttactttttatggcttaagatgttacatagaggttacatgcatatatggtggatatatgtagagtgtaatgtattgtgtaagtttatttattttttccctaaatcagtaactcattttctcattaccatttactattttttacttttctcactaatttggaattctaattttcatatactaaattaatatgcatgcctgaatttgtttctagattttctaggtgggttacattcatttctccacattttcttatgcctatattaccctctgttaattactgtaacttctttgtgggttttgtgggatggttgcggcacatgttctattcacaatccttcttcacattgttcacttttaaatttttcttgctgttatgtattttaactcaaatgaatatagttttattgtgtttcagggttaggtgagcagagagagggagagttttcttactaaaatttaatttatttatgtaattgcatagatgactataacttcaaattctcatggctatttctttatccaataaattttttaatgttgtggcctttttaggatgtagtaacttaaaggcaactttcttacctttcaaccttctcatttgtatcccactttataatttaccgagttagtttgcattttctgatttcttcctcaatggaaccttatgaaaggtttgtaattttaatgtccatcttcagaagtgaaaactgaaagtcaaaagaatgaaataattgagtaagtcatatagcagcatagtagcagtaatggaactagaatttgtctgttccacttagtgcagtgtctcggtaattagaacaaactaattctggtatcaagcgttacactttgtttactggttaaagagacatacgagatttcctccatactgtcctgcagcctgggcgttcctttgccatagttgctggatcgcctccctgtttgaacaaaacaggacagaggaaaaggtaacctggaggagaatgccacatccgctgatttcaggctcgatgaagttcaacacttcctatttcaaggtggtgacaccctctacaaatccctggctttaggaagaaacctcttgataaagacccctcatccacagagttgcctccaagcctatccttgttctaatccttcttctctgcatgaccaaaacttggtattcaaaattcaatcttagtgttttctggctgtgctaaaggggatgtggggacctcatgtttggcttacctgcaccttctaagctagcaccactgtcttacttaatggactataatttcatctccttaagctctcttcagaatgctataatgaaggaggtgtgacttgggtttggaaatgtggtggcaaattatctatatatgaattaacatgtataatttaatacacatcatgaataatgatgaattgcaagtttaacttgatcatttaagtagagggtaaaatttctctttgtccctggtatattttatagagtaaatattaaaatttgatactctggctttgtggatatggtttcatgatgtacaaccactgtttctaggcagcccactccccagtatcacattgtagacaccttgaggacagggagatcttctaaatctgcttcatctctttacttcccaagacaccgtgaccaggctctagcatagaatatttgtttgctgaataaaggaattaatgaactaatgaactaatgaactaatactactttgcacttcacacatctctcaatttcctttatttttgtattcatttctagaatcatacagtgtaaactttaggtaacaatatagagataacacttttcccatcctgtgcaatggcattttgccactagcaggatgcaggagacaattggaaaggaaacagctttaactgtgtccattttggccagctgttctttgtaaaaggtctgtgataaaatttgatataattcagcacattttgcattagttagatattaatgttaactgataacttttgctcctgttagtatagaaggagtttattctctatgaacttgtcccacaagaagcactgtcaactcagaaggcagtagccgacgtttttggtatttgctccaggttccttttcagaaaaggtcattgttggatagaaaggcagcatgctttggtggctctaccaagtggagtctatgaatcatcacctggaactatgttaggaatacaaattcagtgatgcccttcagccctattaagccaaaaactctgtgtaggaccaaatagtcagttttaacagcctgatcatgtgattctgatgagcactaaaggttgagaaccttgactctgtggaaaaaaagccaggatctgaattgggcagaactgaatcagaattttagctcagccatgtattgtatggcttcagccatgttaaagaaatctcagccttggtttctttatctataaattgtggagcttaatacccacttcattggttattaaatgaactataaaatatcacactgggcctgccagtagaagccagtcaacacatttagggttgtaatttcctttcctcttgctaccaccattgcatgaaatctaaagtagaaatagtagtttttaatcctttagatatgttattatgtatgatagtaatgtatagggtttctataccctgagctttggagttgacacttttctgacaaaagaatgtgatttacttatgtattttagctgataaatcctagatagaaatgtatgttcccgtctccctaaacatagtagctgtctgtaatcccatgtgagtcagagatgttccagttattgactgctgcataacattctaccccaaaacttactaaacaactatttagctttgctcatgagtttgcaggtaagaaatgcagggaaagcttggctagcggagtagtctctgatcagtgtgttcttggctagggtggcaggggctagaggttcccctccaagatggctcctccagtcacatgtccaacctccttggagctggtcttgctctcacatggcatcccatcctccagggtctgtcctcttgttttaggatttccacagtatggtggtcagggaaaatgcacttcctgcatagtgattggctttcacgaggtaggtagtggaagctgccaggccagttaagacctctgcttataaccgacacaactcgccctgttgctcagagcagtcacacagcctgctcagagtcaagggagagaagaaatagattctgtctctcgttgggtgagtgacaagtcacaatgcaaacaaatgtgtgggatgggagatgttctgctcatctttggaaaatatgatctgccacgagggctcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccacgagggctctttagtagggaatagtatgttgttctttgtatgcagctgttaccaaaaatgcttaaaatagattgaatttaacgattacacctaaacatacatacatgtattttaattacgtttgttgtctaagttttgccttttaatccttagcaatgtaatttgagtcaagtcaggtgagttgttagtgtgagagtgagctgtcatgtcatccatccacgtccccgcttggactgttttacacgacgggacacacgtccactttcatgatgcagtgctaagggttgctctgtcaatgtaaaagctgtgtccgagcctcagggcatgtaaccttacagctccgtggtggagttacatgctttgttgctgaaggaaggaatgttttcattagttttctttatttttgttccctcagtgggatgttattagtcatgtagaggcagaatttctgtcctcctccacctccaaccaggaagtattaatcactgtttcatctgtgttttcgtagcatttgggttattatattattgttttttgctgattattttaatcgtacaaaaaatacatgagtacattctgtttataaaatttcaagcaataaaaataaaataagtgttcacattaatctgcatccattttcccatgctaatcccttcccagagataagcaatgttatcaattttgtgtacgaccctccagacatattctctgcatcaagatatacacagatatgtgaacatgtataatttactccaatggaatcatattctatatattgtggtttcctttattcatttaaccgtattgagttggagaaatttatatgtagaataactttattctttttttaaaaaacagctgcatagaaggagaatcacttgaacccgggaggcggagaatgcagtgagccaagattgcatcgctgcactccagcttgggcaacagagtgagactctgtctcaaaaaaaaaaaaaaaaaaaaaaagaagaatattagaaaattacaaaaaaattcaataaaaacatctgcaacaaattccatctcatgaccgtacagtagtgaatttaactcttcccctacagatgaacgttgagattgtttccagattttcactgaatacaataccctagtaaaaatttctgacattgttctttgtgcacctgggtgagtatgtgaccctgtgtctagaatggaatactggatcagacagtgtgcatgcccttatcaaagatactactgccagactgtcttccaggaaggccattccacagagagtcaaccccctaccacacggcctcatcaatgatggctttttttaatcttttctgagttttgcatatttgataggagaaacagatatatccagttgttgtctttccatttccatgttcattaattaggtgtcccatatttttccgtgcttattgagcatttgtatttcatcttctgtgactatgttttgttcattttattatggataccatagaagtgtatatgttttcttgaaacttcattttgttccattgataattattttattcttgggcccaaacatattaaaatgtaacatttacccatttaatattaatttaatacaaaatatataccaagcatcattgggcattagaacattacaaatacaagggtaaagaaaacagacaaccagctgtgttcctgacgaatttccggaaagtgctgaagtattaaaggtccatcctaggccatacctacatgggtgaccctggcacaggcctgagtttttgctggtggctctggttatagtatattttgatatctggtaagatatctgagaaaaatttctgtctctctctgtcatctatcaatgaattcttccatctttctatctactacttattagatgtggggacttagacaaattcttatcagatgtgtaatatagatccaggccatctggcttcagagtttatattctttcttttgtagatttaatagagtttatattttttcttttgtagatttaatataaaattgtaaattttagaacttgtcaaatttcatagaaaagtcatttgggactttgataggcacagtggggtgtgtaataatgtattaaatatttttatgatactgagttatcccacttagtaccattgtagaccttcattaaatcatctatgattttatgtcatttccataattttgtccttgctcattattagatttatcctcagatattttacaattttgtgctgatacaaatgggatcttaatagcattatctaactcctttatagtgtaatggaaagtgtgaattttttgtatgttgaccttgaatctgtatattttgatgatttgttggtgtgtgtcctaagagttgtgagttgatagtctttgatattctaagacaaaaataaagacagttttgtttctttcttctaatcttcctaactcttatttcttatttctaaattattattattatttggtgtatgtattcaggacagtattgaataagataagatgatggggaaatccttgtattgttttgaacattaatggaaatgctgacttttttctgaacatttagtataatgtatactttaccttggtgatggataacttttatcaatttaagtagttttttcatgctttttcttgtactaagagcttttaataaggaattgagtttgaattttataaatgtttttcaacacattcaaaggtaatttactttttatatcaattaatgaattgatttacattaatatacagctaaatgttgaactctttatccctgaatttctgataaaagctctaccttgtcataatatgttcttttaatatgctactaaatttttaataaatttatttttatataaatgtaatatgtgtatatatataaaatatgatattatgtatatataatataacctttttctaatgagtaaaaatggcccacctttcactgccttatcctcttgtttctggttttagtatcagggttaactggctctgtcagatgagttgatttttcttatattttctgttcttctatttatttatttatattttttgtagaaatgggagtcttgctttgttgcccaggctggtcttgaactcttgggctcaagcagtcctaccaccttggactccaaaagtgctgggattacaggtgtgagtcattactcctttctattttctacctttggaaacagatttcctaatataagaatgatcaagacatgaagtctgatagggtctacctgtacatcagtgcaggcttgatttcttcaagtcatcttactagtataccaactttctcagtggttattttactgtttagataattctctttgacccagttttggccatgtagcttttcctaggaaattagtcctatcttttagatcattagttgtatgaaattttttatactgcaagtaatagtttaataaaatcatatatgtgacatcattaataaatacaaattttatctatagctttgtcctttttcatgctatttgttttatatttgttctctctctttattgcttttaataggagataggttatgaaattaattgagcatgtttgtcttttcaagaacattattttaaaaaattttctattttatacacttaaggttttattttttactaattatttataactttatgttttgatatatttatattttaataggtccctaatattcattatgtatcatatatttgtagctataaattttcctttgaatacaatatcatctataattcataggtgttaagttttattgctgattgttgtttttgtataagtagtttgtgatttccctgataatatttatttaatccaagtttttaacagaagatttatcttaacatttttcccttgtgttttttattttattattgtataggttttttttctttcattgtttatgaatgttgaattttatttcataattgtgaatgggactttttgttaactttagaaatattctgagatttcctttgtattctgctacactgttattttaggtaatgttctatatgtgtttgaaaaaagtatgtattttcattgtggtgggtgaaaagtcgtatgcatattagatcaaattattaattgcattaaatatattctctatatttttatttatgcgtgcttatatagtctgttgatttcttagaaagttagattatccaactgtaagagtgagtgtgccaatttcctttcatattcttgatttttttcccatttatgtgtttggaagctaaatttttagttccataaaagttaatgtctttcatagtgtttgggtagaagaattttccatgttgtttaaatggaatagctttctttgtcttcatttcctattctttctacaatttctgagccattttatatgtctcttttgactgcatatggctgtatgcttaaatttccaatcagaaagacttgttaggggaattgagaccatccacaatattgtgtttactagtgtatttggacttgctcttggcagcactccttctttattatagtatgtttatggatatgcatataaatatattatgcctgcaatgaactatgaagcattattgcctggcaacatcaaccttagttttagttttattttcctagtagttttctcattttgattaaaaaccacagaatgtcagtggaaagaggggcccctgctctgtgccctgcatttgggcaggctctgcttttgttttgggcaaggagaataacaaatgcttggagcctgagccactgcctcaagcctcctagggcctggtaggcctcttacaggattctcattggccaaatgccaatcagtgagtggatgaccatcctctttagactctattctccccaataattaaactctgtcctaatcaatcactctaaggcatgactgtgggcaggggagagtgaaagtgatgggcagaatttggacttgggactgggtggtccacttaggggtgtattacactacttgccacgcaagttgaagctgagggatgagagtgagaaagtgagatgtcacctccctttttgttcctcttgcacagctctgacgttgggggactgggcacccctcttccagctgccgtgttttggcaggaactctgagaatgcttgaacttaaaactggcattttggatctttacgtagtggtatttccaagtaagaggaatagagcatactttatttaacaactttgatgtcctgacttactacttttaaacactaagatttatgtgggcttccattgttactcttacctcaggccacagacgtcatagaagagcttggaaaaagttaaattcttggggagaatagaatagaatctaaagagggtgatttttgactccagcatctctcaggtttctgtttacccacctgcaccttctcttctggttctgaggcaggtgcttatctctttggagatgtgctgaggcagaatcagatcaacagctcttgcagagaagacgaagtgaggcgaggttgttaggtctagagtgcagaggggccagattagagtagccctggttggtggaagtatcacagctgcaaggataacctgagtttcctgtgggttaagaataggtcatgtaaggtatctgactgaagccatcttgccaggtctcctgtcaacagtggagcattgttgaacagattatgaggggtaagagaaggacatgaccgtgcttttgctggatcttctgtgtcagggacctgaacaaagttttcctgtctcccctgccaccaccagcagagcagtgaagagcaaccaatatgtcctgagggagctgcttttggaggcctgaaacatagaaggaaccaataaccagcatgtgttagaggaacaaaaacaaaaaaacaaaaaacaaaataacagctgtaagtaataagacctgcaaatgcaaatcaatgtcttgttccccctaaaatcaataggtcccctgtgccttccggcacactcacacactgacacaaccacatctggctttcttactggtgtagacaggagggacgagcagggggagcagagagagagagaggaaacaggcttcttgaggcatttctagtctgagctgacatttcattttaaaatggaaaatgatacacaaaaaaatccagcgtgaccagaaaaaattataagcctgatacttgtagttgacaagagtaagttacctttcccgtcaccagttcacctggtgctgataattcagaaagcacatatagtatcaggtactagaaaaagtaaatcattccacatttgcctgttgctaggttgaggcaacttaataatacctgctgatttctctcatgtctggacattttgagtgtgtgtgtgtgtgtgtgtgtgtgtgtgcacatgcacttctgtgtatatctgtgcatgtatttacaaaagtagagtcttgtattccaatgcccgttttaactcaatctcttcatacagatttcattccaacatttgtcacaagatattgcactatttttttttagctgtctatctttactgctagaaggagattttttagaggagactccgatttaaatattgcttctatcatagtgtaagacatatagtagattctcaataaaaacctgtttcttacatttaagctagtgataatgtttgtacctattaagggtgctgaggctattttccaagacccagttggaagatactttaaaagtaacttttctagatcatctgttaatacttctgtagccttttacaggaacagaggaaaagtaaaataggcagtgaggaaggaagtgctgttatttttgtgcatatagcatagtaaatgtgtatgtacctggcatttactggtaaatcaacatgtcagagagatgttatttgttactggctctgtgactaattatccctctagatataatcagtgttaaaggtagtgaagtgcaaaataattgcaacaacaagacctatgattcatttcaaccaggtttatagagtaaaagattctttttcttaactttagcagttttttaattgattctgtaattttacaatggcaaaaaggtagtttgcagtgtaattctctattatttccgtattgcaaattcaatctatgttagatatttgatgccatgggttagcattttttatttgcaaattaagtattttgtgaacccaccatatgttgaatgatatgtagaacagaggcatggagaagccagaaatatttgtgtgtgtgtgtgtgggtgtgtggtgtgtggtgtgtgtgaaaaaaatatgctagaccaaggtatggagagtcagacttccaaaactgcatatctcatctgagtacaatccttctatccaggggagatttaggtttggtggggctcaaacctcatacaatttaggaagcacattttaagaataacaatacaaaattaagaacacaacagtggctgggcgtggtgactcatgcctgtaatcccagcactttgggaggtcaaggcggctggattgcctgatatcaggagttcgagtccagcctggccaacatggtgaaaccctgtctctactaaagatacaaaaattagttgggcatggtggtgggcccctgtaattccagccacttggtaggctgagataggagaatcgcttgaacctgggaggcagaggttgcagtgagctgagattgtgccattgcactccagcctaggcaacaagagcaaacactccgtctaaaaagaaaaaaagaacacaacattaagtattgtgcctatgcaagtgaagagccccgaggcttaagcttcatgcgcttctttgtaaatatttctctttttatatcaagtcagatttgatacttctctctgttggacatgtgggtatgtaatagcttattaaggtgaacagaggtcttggcatatgggtggtatagaagatgttgtaaaggtgaggacgaatttctaagagttgagatgtaaagtattgtttaccactgataaagacttgtatttataatatggaaatttagaaaacagagtgaaaatatctattatttaataagtaatggaaaagatcaactatgatgacagggacttacacttctggcccagttggagtaaaagagaccttctgaatgagacagcaaaaaagtaataaatggacagaatatatgaagcaaaggttttcaagatactgaacatcagacagtgaagtacagtgatcttgaggtaggaaacaaatgaggaaagtcatatgattgtgccagcctactgctttaagacagtttccaacgtgtagcacagggaggagaacccaggtggagcctggtgatcttgaaaaggagataaagctgaaaactgcagggagaccatggtggctagaatgcacaggacaaagtactggagagaagagatttgtctagagaaaagtctcaaaagatctgtaggtagatacattatgacagaagcatagacatgtgatagaagcaatatgtaaagggatgctttgggtatttagtagaggactgcacagcacatgcaggtgaggaaattactaggttttggaaataactacccaaaatggttagtgggaacaatacctgacactcacactgggccagggatagtgcctgttcctacctgtcgactggaaatttcataaccatcaggacattggatagtactcagagtgtcatgccttagttgtggagactaattaggcatagactaacactgtttgaataccacctccaaagttgtaaagcaaaaaataaaggatatagattattttcaagtaatgtaagtacattctatgaaggaaattaaagaatatctataggaatacaaaagtaaatatcaagcatcctacatggtaaaattcacaatgcctagcacccaatcaaaactaaccaagtatgcaaaaaagtggggaaatatgatccatattgagacaaaacatgcatcaagaaaaatccagaacagcgatagcagacaagaacggtaaaatagttattaagactacatatcctatgttcaaaaattaagtacaaagaagacataaaaatataaccaagtcaaatgcctagaaatgaaaaaatactgtttgaaataaaaaatacactagatgagattaatgtcagattagagactacaaaaaagtaagtgaattggaaaataattatttaaaataaagtaatagaaactatcatgaaataaaactaatagaaactatcatgatgaaacacagagaaaaaacaatgaatgggacattagtgatctgtggggcaacttcaaacatcctattataagtgtaattgtaactcttaatgaagagagggaggacagaaaaaaatgaatcaataacggttgatttttttcaaggagctcaatgaaccataagcacaagaaattggaaggaaaccacacaaaggaacatcataatcaaattgtttcaaaccaatgattttaatttaattgcatcattaatacaatgtaatttaatttaattttaaaaaacaatcttttttaacttttaagttcagaggtacaattgcaggtttgttacataggtaaacttgtgtcatggggcttcgttttacagattatttcatacccccaggtattaagcgtagtacccattagttgtttttcctgatcctctccctcctcccacccttcacccctgaaaggccccagtgtgtgttgttcccctctatgtgtctatcatttagcttccacatataggtgagaacatgcagcattttgttttctgttcctgtgctaattgctaaagatagtggcctccagcttcatccatgtccctgcaaaggacatgatctcagttttctaatagttgtataacattccatggtgtatgtgtaccacattttctttatccagtctatcactgatggacatttagacagattccatgttttgctattgtgaatagtgctgaaatgaacatatgcatacatatggctttataatagaatgatttatattcctttgggtatatacccagtaatgggattgttgggtcaaataatatttctggttctaaatcttcgaggagtcgccacagtgtcttccacaatggctgaactaatttacactcctaccaacagtgtaaaagtgttccttttactctgcaaccttgacagcatctgttatttttttgactttttagtaataaccattctgactggtattagatggtatctcattgcagttttgatttgcatttctctcataattagtgatgttgagcttttttgtatatgattgttactgcatatatgtcttcttttgaaaaatgtctgttatgtcctttgcccactttttttatggggttgttttttcttcttttaaatatgtttaagttccttacagatgctagatattagacctttgtcagatgcatagtttgcaaaaattttctcccattctgtaggttgtctgtttattctgttgatagtttcttttgctgtgcagaagctctttagtttaattagatcccatttgtcaatttttgcttgtgttgcaattgcttttggcatcttcctcattaaatttttgtccatgcctgtgtcttgaatgacattgcctaggttgtcttccagagtttgtatagttttgggttttacatttaagtctttaacccgtcttgagttaatttttgtatatggtatatggaaggggtccagttttaatcttgtgcatatggctagccagttatcccagcaccatttattgaataaggtgtcctttccccattgcttgtttttgtcaggtttattgaagatcagatagttgtaggtatgcagtcttatttctggcttctctattctgctccattgatctatgtgtctctttttttaccagtaccatgctgaagaaacaaccttaaaaacaaccagagaaaaaaaagacatattacatacagaggaaaaatacaaggatgacacaagatttttataccgagccaagcttgttatgactgtggcatagtaagccaatcactgagacaacagttttgtcatggagaataagttttagacaaaaagcagagcaacaaagagatgggaaagcagctctaaaatccccctccccgataatggagttatagggctctttatgggataaaggagcaaggtggtccaagacatggggaaaggtgattgagagtaagaaaatatgaagcaattgatgatctgcacaagcatagtcaagcttcatggttcttcataggatgcatattcacaaattatgtcattagcataatctgagagtggagtttttggccctctgacatcaaaaagtcacgcatctatactcacacaggcccatttggagggtcagtggtctcagtggcttgaactggatgagaactaactctaagttcctgaaaaacaacttaagtaattgttaccatggtgacatatatattagagacattatgtataaggaagctagtgggagtttagttaaacttgtttagccacctgacttttagctacataacgtcttaaaatcaactgaaagcaagtgactaaaacaaggcagagtaagttaagttgggcaggcctaatctggtaagccttcagttttagtatcttattggaaacaatgagaaatcattggagcacggtcttgtggacatatagctctacacacagcaatgaagaacactggaaaggctttgaaaaaaaaaagaaaaacataaaatacaatgaaaatataaaacttgttttatccaaggtgccagtatctctactgtttgcctactgcaatgccaggatctcagagacaaataaaaaatgtgatagaaacaatcccctatatcagtagttgagaggacaatgcaaacaaatacatcagagaatattatatgagctcatacaattgtgtaacatctatctatctatctatctatctatctatctatctatctatctatctatctatctatctattcatccatccatccatcccatggtaatgcatgacatttatcatggcaggtgtctcagtctgggttttcccagaattatatcctaagatgagggttagagtgcaagtaaatcacttgggaagtgattcctggaagcaccagcaacgagtgggaaagtgagatggggaaaagggaaaggcaggccacaaattaaagtatcattatcaagaagataaacactgtgtgcaactagagtctaatcacaccaggaaattgtggatcagtgtacagcagtggcctcaggtggaacttactcttgcagagagaatcatggccttccaaagacaaccatgccctaatctccagagcctaagactatgttatgttacatgtcaagggaaaattaagatttcacatgtatttaaggtcactaatcagctggccttaagataaagagaatatcttgcattatccaagtgctcccaatataatcacaagggtcttttaaatgaggaagaagaaaacagatggtgaaattcagagatagatttgaagctgtggctggcttggaaggaagggggctataagctgagaaacagaggaggcctctagagctggaaaggacaaggaaacagaatcttttcttgagatttcagaaggaatttaactctgttacaacctgattttagcccaattagacacattttagatttaataccttcagaaatataagatatttgtattgttttaatttaccactaagtttatgttaatcccttacattagtaatagtaaactaatatacccacttgaggggtgaggtagttgggtatttataacacataccattggttggtaattgcttctgtatgtggaaagaaagtggcccccaaaagagagagaaagccctttggttgctggaggttagctaataggcactataaaggtaaggcctgctggaatgtgggcactgcacttactagtaaaataggctggcctccctcttcctgtcctttccaccccttcttcattcatctaacatttctcgagcttttattatgtaacagactttatgctagatgctggaaatagaaagacactgtatacatttctagcctagaaggttcaacaaagaggaaaatgtttacatttcctagattctcagttctagactctaggatagattgctgagatatttttcatcaatggaaagaaacacatttttgttgggtttttcaaagaacgtgacatgacacaccatttttacaagggataattttagtgcagaataaaatagagcagataaactgtcacccaaatgaagaaatgccacatttattgttctaaggcgtccagagcaagatatctttttggtatgaatgtgcaattctacacacaattatttctttcttggatgtgagctaatttctattggacattaaattctataggaaggtgaagattagtctatctggatgcctgtttgtttttaatgaagatgttacacaaaataaaaatgaagagcatctgataaacttgtatacaaacactcacacacaaatcttctttaggcatatctcaaggtatttttccttcctcataatgtgctatttacacttgactcataataccagtttctaggtatttcagaatacccagaagtttagcacaaatacaacaatggttatgctacagtggaaatgaagtaagcaatagatgctactgcagtaatttttgaaatttctttgttcttataaatggtcaggcactgcattaaaatttggaagattgcacacttgcagcctctggtgacttcccagattgaatgaggtattgcctccctcatactcttgtaacaatctttagacctgtatttctcccttccatgttgtagggtagctatttatttaatgtctgtctactgcagtaagccgtgtgtgctcctgaaagctgggttttgataatcttattgttctttctctggcatctagatcatgcttgacatatgttaaattctttaaaaatattcaccaaatcagtgggcaaaagaagttgacaaactcaagcaatgtatttcgtatttattattttataggcttaaagtagacaattttgttctgtgttggctgagttaatcacttgtgaaaaacagcaaaattatattgaatttcaaacacatgataaccttctgttgtattgagctaatcaatgggtgtgtttatcttctttttactagtaccatggtttactgtgttttccaaaatactctttgtcattaattaaaacaaaccacattatggtaccatataatctattttctaaatgaaaacactctgtggttttgaaagttcgtttctggtccacaaacaaataatttcatgctcttatcctcatactatttgagtcttagtttttccatttatacaatggagaaagtaaaaatagaaatgcagttttttatttcagagagttattatgaggatcaaataagctggaggacatcaaagcaaatagtatatcatcttttcttttactttttattttttatttatacctaataattgtacattttgtggggcacatagtgatgttttgatgttttgatacatgtattgtatcagatcagggcaattagtattttcgtcatctcaaacatttgttatttctttctgttggaaactttaaatatcctccttctagctatttgaagctatatattatcattaagtacagtcatcctatagtgctatagaatgctagaactttttcctcttatgtagctgtaattgtgtattatttaacaaatctctccctatccctctgttccccttacccctcccagcctctagtatcatctgtattaagaaaatacggatatatggatgagaggacaacaggttatagattttgatagtgggatatcttaaagggaaggaactagttaattatccataaattccttcaatggtgtgaatattgccctttattatggcataattcttaaaatttatgctattgctttgagaagcacatcgaagagccatgccaaaccattctataactttcaggaccttggacagcttctttgcttcaagatagccaagaggttaaggcaaagacaacccaacagggcaaatttttttttctgaaaaagaaagtttgtttttaacccacactgtagcgttgtttatagcctcctcccagttcatccttgaatccatagtatatttctctatacatactcctggataagaagaaacaaataataggaagataaagttaggtattgtcatcagagcattaacacagtgatcttattttcgtaaactcttaatatcatatatatatatatttgcatctttcttttttctttcttttgtttttagagatagggtcttgctgtgttgcctaggtttgtctcaaactgctggcctcaagtgatcctcttgcctcagtctccaaaaacattgggattataggtatgagccaccatgcctggcccagcatcttatgttttgtagcatctagccataatgtatttttaaaaatttcctggccgggcgtggtggctcatgcctgtaatcccagcactttgggaggccgaggtgggcggatcacaaggtcaagagatcaagaccatcctggccaacatgatgaaaccccgtctctattaaaagtacaaaaattagctgggcgtagtggcgcacgcctgtagtcccagctacttgggaggctgaggcaggagaatcgcttgaacctgggaggcagaggttgcagtgagccgggattgtgccactgcactccagcctggcgacagggcgggactccgtctcaaaaaaaaaaaaaaaaaaaaaaaaatttcctgtctgtctgaattcaggaaccccaggtaactttgtgtcaatgttatctctgatttcctccacagagtctctatgggaaatattgtagaggttatggcttccaccctaacaataatataacataaaaggaaattctaaaatcttgctcatatctaatgggagcatttttgggaggcattgtgcacacattgctagagagctatgaaggaactgtttcaaatgaagagaaatgcaagcctaggcagtatgaaatgtatcttggtaacagccctctgtcctgtaatttatcccacctagttttctttttgtttagattgtcccacttaatttccttttgtttagattgttggtttttattttcagcaatgtcaaatgtaggtagtaatttgatttataataagagcttacatccaaatgttttgatagcagagtcaaaagaaatacaacctgagccatccccagggagtcatatacatacggactcacatgcatgcacaaacacacacaggagccacatttgcaactgcattacggatttacaaaattacttgtatttcattcaagaccgctctaatgggttttaccagatcagaagtgaaaattttaaataaattaatagacagtttaacccaggttatagtcagtcactcaggcaatcagtctagctttgtctgtgtattttacaaactggccacccaagttcagagtgaatataggaacaaaaaatcaagaagaccacaggtaaacataggccaaagggttaaccaaccagcccttactaaaaaagttagtcgtcatcattttgccccacttcctcatcgcctttcatggtgtttcacaaattttataggtaaatgagtaaggatgtgatctcattcacttatctattccgtttgaatataaaacattttgtttccttcccaaatctttaattgtatcttgataaagaattcaagcttctttgtactttgtaggagttggagatttttttttttttggttgatcatgaattattgaagttcagtggactggaattggaacacttggatcggagattttattctgccaattattacatgtgtaaatttgggcaagttagctaactttagaaacagtcgtcttgtcagttaatgagggtattattatatctgtaatgcctttcatcacacatggcttttgggggagtcagataataagagtaaaagtaacttataaactgaacaaataaaaaagacaatgatttaccaactacttccaacattactatttaaaccatgactttgagatgctatattttaagaatgaaaaagaaagtaatctttattttaaggagaggggcaaggcaataattttccataagagggcacagacactatatacaaaatggaatctgtctcagttttcagaattttcatttgctagctcgagtgcaagctgcttgtgttagtttgcgaggacttccatacaaaatatcatataataggtgctttaaataacggaaatttcttttctcacaattctggaggctagaagttcaagagcaagttgttggaagatgtagtttcttctgaggacctctggcttggcctgcagatggccaccttcttgctgtgtcctcacatgatcttttcttttgtgcacacacatctctggcatgtttttgtgtgtccatatttcttataaagacattagtctcattggattaggacccactctaaggacttcattttaagttaatcacctcttgctcttgctctaaatacagtcacattctgagttatggatggttggggcttcaatgtatgcatgaagggagcataaatccgtaacgtttgacttttggatctccaaaatccctgtccttctcatatgcaaaatacattcaccctaatcccaacagtccaaaatctttaccgatttcagcatcaattctaacttccaaaactcatgtaaatattatctaaatcaagtatgatgagagacttgaggtatgattcatcctgaagcagaatttcactccagctgtgaacttgtaaaattgtacaagttccgtatattgaaaatccattgctaagacaggaatgggatgaaaattctcattccaaaaggaataaatatgaaagaagaaaggaatcatagatccctagcaagtttcaaatgtaacagactaaattctattagatattaaggctcagtagtaatcctgtttggcttaatgccctgcgctccaggcccactggggtggtggctctgctttgtgggtccaccgggacagcaatgttgccttagccctgggaaatagcgtcgtcttctgatgccttgagtgacagtcctgtctctatcatcctgggaagtggcagcctggtccactgaagctaaggaggtgcccctcattctgaaatcaagaaagagacagccttggctttccatcctcccaccagacctgggcccatggtgagagtggcagtcccgccaatctctgaatagcttctggggtcattctttcatttccttgatgatggataacatatgtttacagccatttaacttgattaaatggatattgaattctcccatcctgtagaattctggtattccaatagcctttctttatttggggctatgtctgtcccctttagtccaagccgacagtgttttctgctgatataagcccatatttattcctggcttctgctgagataagtgattagatctatgagtcacatccataatttctttatggagtaattgtccagctacattcttggttttctttccaaaacataccttttattttttttcaataggaataagctgataattattcaaatattcaagttctggttgctttttgcttaacaatttcttcttcaataatctctttcctcttgcagtttactataagcagtaaggagaaactagactgtaccttcaacactttgctcagaaattatttcagctgaatacccaggtttgtcacctacaatttctactttccacaaaacactgggacacagttcagctaatctctctgccattttatggtaagtgttgtctttcctctagtgtcaaaaaatatatttctaattttcacctgaggccacaacagaagcaagcacatttaatgtccatgattttacagaaagtttgttcaaggcaatctaagcttcctctaatctgtgcctcaaacctctcacagcctctactcattacttctaaagctgcttccacatttttaggtgttcagttctttagcatcccacatcgtggtaccaaaatctgtattagttttctggggctgccataacaaaataccacagacaacaaaaatgtattttctcatggttaggagactagaaattcagtatcaagtttcagcaagcctgagcctctcttcttggcttgcagatggccatcttctgtctctgttcccacgtgatctttcctttgcacctgagcatccatggcagttcttttttgtctacaaaatttcttcttcttacaagaacaccggtaagtttggattagggcccaccctaagagcctcatttttacttaatcacctctttagaggacctgtctccaaatacagtcacattctgagattctgggagttagcgtttcaacatatgattttggaaagacagtttcgtaacttaacaataaatgaacaatttgagcttaacataatgatgaattttgacttaggaagaagcatagctttagcccatgtaacactgttgtatatcatcactgtgaaaggactggcatcttagtgattttaaaaccatgtttccctgagtctcgggcagtgagtcaggagggctatgtagactgtgtccatggttaggtggagatgctgatgggtttcggctctcagacctgttggacacagatgtaccataccaggggaaagtgctaaattgcttgtaaattcactggcactccaatactctatccatgtctggaaataaatgaacatagagtctgtgatcatattaactgaaccacacatttggctaggaatatcagatgataaaactgagtaattaaaataaaaattgttctaggatacctggaatgcacagcaattgctccttttcttaaatgttgatggccttacgcaatggtgttcacagcacacccctctttatcttggggatgctttctctgatggatgggcttcaaaattgctaatacacgaattactcatatttagacatttgttcttttaggtgccagactgttttcttttggaatgtatttttgtgtgatgcaatttgtcacctagatcttagcattaacttttaaaggatgaatgttgatatattggttctctttttttataatttcttgtatgacaaagtaattactacctactgtgttctaggcaccacactaagtgctattaatgtagccgtgaatttacgttgtcttcaccaagggtatcataatctaatttaaagtattttttcctcttgtagaaataccttcttccatgtataaaggcacctaaaatgttgtacagctcaattaagcttagtatctttcttgttttactcaatctcagtttataactgttgtagattaaataatggcccttcaaatatgtccacatcctgatccccaaaacttgtgaatgtttccttttaatgctaaaacaatttaaatatgtgattaaggatcttgatatcgggagattatcctggatcatcctggtgaactgctataatcacagttgtttttatgaaaataaataaagaaggttcaaagaagaagagaaggtggcaaggtgataatggaagcagagataggaatgagtcactttgaaaaaggtggaggaccccaagctaaggaatataggcagccactaaaaagcagggaaagagtctcccttcaaagtccccagaaagaatcaaccttgctggtaccatgacattaactcagagagaccatttttgaacttctgacctccagaattgcaagataataaaattttgttattttaagccactgaaggttgtggtactttgtcatagcagcaacaggaaactaatagaatcacattaataatcaccagtacactcaaaatcatttatctacattcttctttacaatctgctcccacatactattaccactgttattaatttatccatcttaattgtaatccttccttccgtatttgcatcatgctcttaatttagaaacttgacattccacttgaaatcttatggtcagtttccaaatggtatctctgttttcagcctcactccttccaaacttttctccagattgtttccaaaattttctcataaaagccaaatacgaacttttttcttcttaaaatcctgtgatacctcatgagcttctgtcctgtttgccaaactcctattcactcgtcaagaggcagtttaaatatcttcttttctgtgactctttccacagacataaatgtttgcattatcttctatgtttcaaaggcatcttgaatatattttcttgaaaaatccttttatatctatcgagacagatagatatagagatagatgcattccagggcagcctgttttattactatacatatacaaaaagactcaaaaggataagtaataaaatgtattaactgcaaattccttctggaggtaacattataaaatatgtgctaataacaggagaaaagaaacagtgaaaaaatacaaaacggtgttttcaaaatatgtttttcataaatagcaaaggctttagaggagatatgttacaatgcccagaaaacacaaaggaaacacagtatgcaaagatttacacatgtatgtagacatatcagggaagggaccagagaacaggaagataaatacaataatagttaacatccattgtgtgctttccatgagccaatactgttctaagggttttcatgttaattcactaaacaatccttcgagacaagtgttgttaataaccacttttaaagttgttatggagactgagcacaacattaatacaactaggaagggatttgaactcagaaagtctgtttccagagcttgttttcatatccaatatgctttaccatctcagctggaaggttttccactgctgctggatgggcttttctgaaagtgacctaggccaagccatgacggccaaagtggcccaagctcatcttcagagatgttcactggatggtggtgttcttatttttcaactccaaactcagcctgtaattctcaccaatttcaaatctgcaatcacttaagtctataatcgctatcaatgatatttctaacacatcccagcaattcttaaaaatgtctctccttattgtaagaactcctaattccacgagtgattattaatgcagggagagagatgagaagttacctttggggatataattgaaaagtgagtaggaagcaggcagaggaagatgaagtaatgacagagattgtgttgtgagtaacgcagatactttcaataggatatgcccaagttttaagtgtgtgaattttcaatgcttctctttatcctccattgtgtcatatagcatgaatcacccacatgagtgggtcatcaaatcaattttgtgggtcacaattagcctttgataaaggaaaataacatagaatggaacagaagagcataatatataccataacatagcgtaggtatatttgcataaatctgtatcagtcatttcacactttgcaaaaattactgcaacaagtggtaagtcacagtgccagagagccaattagtagagggagtacactgaagatgcccactgggtagaatggcttgttttgtctttttaaaattaacttcttatttgattttttggcctgggagaatcactttgatcatcactgtaaagaaagggcacagtttattttatattaacataattattagttaattgtgagatgaagccaggaattatttttctatcatgaataaaagtattgagattttcagtcaagtttcaggctgcaaaattaggctgtttttcagaaagaacattaccaaatttgtaactgtaacattctagtaaatttaatactagtacccttaaaattaactgatatattattaaaaagaaaaaattatgaatttaaaaatgtaaaggtatgttttagttcaactgaaggatttcaaaatgtaaatagtgaaaacattgagaaaaatattgacaaaggagcaacactgtcaatttcaggcaaaagtttaaaatgaaaaatttagtacaaatcatgaaacctaagacactcaaaatcattttaatcaaatatgaaaaatccagtgaaaatgacgcctgtgtttatgtaatgatattttgcaaataaaaccttaaaactttcaaaattaaaatgatacttggaaataaaggttattgtacttaccatgtcttttaattatttgtaaggaagggaaaatataaattcattggcacaatgtcttattcatttgaattttttattttattttaatttttttgaggcagtcttgctctgtcacccagacgagagcacagtggcatgatcattgccatcttgatctactgggctaaagtgatcctcctgcctcagccttctgactacaggtgcatgccaccattcccagctaattttattttattttataatttgtagagacaagtactcattacatttcccaggctgaacttgaactcctgaacttaagtaatcctcccaccttggcctcccaaagtgctgggattccacaacctttaatataaaatttctactattgcatagttacagcatcattgtgtgtttaaaaaaatagcacatataactttgaaaactatattaccctgtatagatgccatagtgtgtgtgtgtgcatttttttttttctgagagggagtcttgctctgctagctcttgttgcctaggctggagtgcagtgacgcgatctcggctcacagcaacctctgcctcccaggttcaagcaattctgcctcagcctcccaagtagttgggactacaggcgcacgccaccacacccggataatttttgtatttttagtagagacctggtttcgccttgttggccaggctggtctcgaactcctgacctcaggtgatccgcctgcttcagcctcccaaagttctgggatgacaggcgtgagccaccatgcctggcctatttttaagaacaaattatctgacagaaataaaacctttattttttgacacgatatcccattttgtaacttttagaaacaatgactgctatattgatacaatccagtataaataagcaaatcaacctgatgtgagaaatgacagtcaagagtgtgtaaaaatgctagctaatggcaaatggcaaaatggcttttggagggtatgtaatgtagttaaaatttgattaaatgttctttggaattggataagagcatcgttgatcaatatgaatgacactggtaaaatgatatatgagttacaattgagagagcaaaatatgtgactaggaaattatcagaagctactaataataagctctttgaagtcacttgttaaatttatcttagagctttgatatccaaagaaatttagctgccttttatggatggggaaagtaagtgaaaaatgtttgttttattaaaggaagctcactgaaatgtttttgatatatttcgtccagagattggtgctatgcatatccatattttctaccatcctagcattcttagattgtcatgaccaacaatactgagcaaaggtaagaatcaagatacaagattcactttttggttattgttggagaataatcttgtatagtaagtaatttctaagataatatttgggttaaaatggcagatttaataaactaggaaaacaaagaaaaaaccaaaatgcatttcaatatattgaccttatccaaaggtgatagtgtagtgttttgatatttaatttacagaaatgctctgaaataactattgccatcctgctttcttaagtaaatggtctagaggtcgtaggagttagcccagctccactaccatggagcaagttaatttgtagagataagatttgaactcagttcaaataaggctctgaaagctatgttaaggcctctcactgccctccctctgtaagtaagaaatgtgaggaaaccaagatttactcattaagcatgcccggctttgatatattttcccagattagaggaacagatggctcttagtggtggtttttgttgttttcatggttattgttattattattgctaatgcctacctattttccctatcaaatgaatcaggaagctttgtccagtccctcttaattaaatgcagtgagagaaatgggatatcaatccaatacattgagctcagcttgtcctgagagtcagggtgcctagagaatatttgatatgccatgagttgcacagtgttataatgggccctgagttagtgttttgtgtatagtattcgtggtagagtcctgtctcttcccagataagtgtgtgttatataggatataacagtaagtagacataagtgcttgtttttattattagaaggctgataaggagcagagaacttgtggtcttagcagcccacattaaggaatgcaggttctatttaagtgcaatgataaatcaatgatggatttccaaacccggatgtacttttttttttttttgaggaaaagaaaaacctttgttgatgcataaggaaaggctgggtagaagaacagagttaagggtgggaggccagttaggagactgttgaagtaacgcaagtgaggcattatagtggaatggactagggtggttagagcagaaatgaaattacactctctgtatattgcagaggtagaattaatcaaataggacatctgaatatattagatggggtgagggaaaatggactaatcaaagacaacccttatttctggctataggaataggatattgtcattaactacattgggagacttcgagtacggagagtttttttggattgtggaaaattaagggttctgttgggagatgcacattagaaaactaagtgaacttgctaagtatacagttggagattaaagcaaaagagttatcagtctatagatagttagagttagtgtgtagacatctagtataagatcacctaggaaaagatatagatggtgaagaaaagaggacccagtcgcataccttaaagtacattgacattaagaaactcgacagagaaagaagaaatagcaaagaaacgcaaaagtgactgtgatgcagagatagaatcaaggagagatttgaggtttacttactatattaaatgtggagaatttgaagatgaatctaaaaaatatttgtctgttttctccgagggaatatttttatggttcatttataaagtcatctgtattgttttatgtgacaaaactggtttcattggttctttagattacttactgtcatttttggatttgaggtcataggagcccagaggggcaaaactctcagtaggaagcatcagtcgtgtcaatactgctgtgaggctgagtagaaagatgagaagtgagaactttttcttttggtgaccaacaagttattgatggccttgagaaaaatgcgactctggagatgtgtctgcagaagctggactgtagttggtgaaaaaatggacaggaaatgaaaaaatggaaaaaaaatctgtccagaaggttgactatgaagaggagcagagaaatgaagtataaattaggagaaggctaattgttcagggggcaaattttttacagtaggaatattatagatcatgtatgaaacttaagggactgatgctggagaaagtttgaagaggcaaaatatgcaaagaggaatgtttggatggtccttgagaaggtgtttgcgacagagtttgtagtctaagaagtgattgtccgtatctttactctttagatctcaatgttctcatctgtaaaacggtggagtagctgtggattatttccaagcttctttgtgacttgaatattctacaaatttattactgttagtcatgcatatgctagtaagcagtgatgaacatgggagatgtatcctgaggctgtttactctcatattaaaagtggagaatttgaagataaatctaaaagatacttaagtctattttctccaagggaatatttttatggttcatttatgaagtcatctgtattttatgtgagaaaactggtttcattgttctttagattacttatcctcttgtagaaactgtaactattttgaagtttgaggctgcaacatattcacattggtttcactgttttaatcttattttcactgcttttgccatctaaccataagatattggtgcagtaaggataattaagtaagataagtttattaacagcagcaagtatcttgaagacatacccatttcagatgtatgttaatgaccatattttttactctactatgctggaaggttttcgatggaattcccggaaaagagacttatagcagccatataaataacaattacagagagtattattggtatttatgctgaaatgccttttatattgtctttaatacttgagtagaacttaattgaattatatttgtcaaggtaactttttcctcttaagaaaaatcccgttgcttaaaattaaaaaaaataaacctagtattttctacctactagtaaaatgcaagtttacatattaaactcttgctttgcaaatgttaaattggttgaaatgagtcaaattggcaatttgtttgtaactagaatgtgtgtgagaagctgagtcaaaaatttgagaagcctccattgcccttttcaacttacatggtacttatttatgcaaaaggaaggcacatcaggtatgtcgtgacatgggctgaaacctatgtccatagaaccaggaagagttgggcatgggatatagctggttgatggaaactttcaagctgatatttcagtgttaattattgtcttcaatatgtacattgtttccaagaatcatattttgctttatcaaatggatgcattattatattttgttaatatctctgatccttttttgttcagaaaatggttattatctcaaaaatcataggatttgagaaagattacatgatataacaagtataaattgtagatcatagaacttggcacctagtaagcactctgcctcagcactcatgctcaaagtctgttaatgagatctgaatctggtggttttacagggtacaaaaccacaatgatttgtgaatatgtgagtctatggtagaatattaatgtggaaataatctggagtgcatacactgtgtgggtcccccaaaggcatgggtgattgtaggcataattaaccaaccttccttactcagaaagtggaaatggcaagttagagttttctaaaatataaaagcctatttaccagttctgtgatgagattttttttaaaaatccacacaaaaacaaaacaaaatgaaaaccacacatgatttagcttgtttggattgctatttgatgatatttaataataatagaaataattacctctgaacaaagttaattcagtatacattttgctattacttttctcttaagtaaaataatatctatcacccatgaatattttaaagaggtagctctttattctccagagtaaactatgtaaattcccaagaaccaataatttccataattattaaacaaatattatatcatagtttctgagcattagtcacagaaaaactcctgagattagattgagacaaagtgtcatgctttacgtttttactttacttggctaggattctcttattagaaacatacctattgtattattattttcaagcaaagaaaacaaaattccattgtaagttgggtcctttcacacttaatataagcaaaaactgtcattttttcattactgtaagctgattgaaaattgaaactgtgaacaatgtagctgttccaaataatagtttaaaaaataaaattatttttttctttgaatatatattttatttatcagaactcactaaaggattatatgtggaaagaatgttggtttataatttagaaacaacattttttagagatatttgcatttgcaacataatggaagttgatctcatagttgtaattgtcaataactgtctgctgtgcttgagactatatctgcccttgctcatttctcactctgcactcctggggaagtggaagaacattggccatgtctccttttgctgggcataagaaacatatataaatagatacgttataaatagatagtttcaagtaaataatgtgttctcttaagctcacaatgatgacttttataataaataatttctaccataacaaatgatttctttgcattattgcaaatacagatttcagcaataactgttttaggttccttttctaacactgtggatgagctagaatgactctctttgtcctctccttcagaggtctctcctgtcacctcctctttttctgtcttcccatttagcttaggggtctccattctataggctctctcacaccattgtcacagctgcactgtgatccaatatagacattctctgtatgatagcaactcctattgagtgccagcagatacaagtcctgcaagatgcccaaagaataaaagagatctatggtcaatagtgtagccatcttacagggtcaggattccattcatatattaaagtctttgtgagacttgcagtaatgaaacctgtgattaatctatacttccctaaattactttatcatgtgttttagaatagatatttctagtctgagaacctagttatattggaatagtttgggaaatgtcatgttactatttgaacgataagaagttatctcttcatttagaagaggtaacctagactaagaatgattgatatcacccatcagatttcatctgcttaatttttcagttctgtgcatttaacaatagaaagtttaaaacgagccatccttcaatgtgtttagcattataataaaagaacataggaaagatatagtctactgttctcattttacagttgttgaaactaaagcctagagagaggatattagttgaccatgagcacacagcttagtttaaagtagctgagatgtgagttgttttttgttttattttctttttgagacagggtcttgctctctcacccaggctggagtgcagaggtgtgatcatagctcactgtaacctcaaactcctgggttcaaatgatcctcctgccttagcctcctgagtaggtgggcctacagatgcatgccaccacaaccagctaatttaatttttttttgtagagatggggtcttgttaggttgctcagcttggccttgaactcctggcctcaactgatcctcccaccatgtcctcacaaagaggtggaattacaggcataaaccatgcacccagtcaagattgtgatccaaattcttattttccaattccaaatttagtgtcaagtctacaagttcaaactactttcattaaaagagaaccatagttacaataatcttgatagaacccacagctttttgtaaatggttttatttgtagtaatatttttctgtttgtaatatgtttctcgtgaatcacatagaagcgcagaagcattgagaaagcccatgaagctgggtttttgtacatttgtgcatatagcagattgaacccctcttttgctatttaatatagtgtgaagatttccccagtgctgtacttactttccaaaaacatgattgtttctttagacaatttcctattgttgtttccaaagttttgctatttaaaactgtattttaccaaacgtacgaaaaatgtaattgctgggtcaaagaataacaccatttctagggtttttctctgtaatgacaaattacactctaaagtgttatcagtttcattcctctcagtagtgtatgagaagacacttgtttattttttacaatcaaacatagtatcttcaaattgtccagaattctgagattactttctttactgttgactatgtaaaatagtaacttaaaatgctttttatgcctcttggatttctccctaatgtccctatttctgttgataataatgaagttttctatttatgatttaaattgccattattatatataaaacatctgtttgaaagtttaaataagatattgtgttaagctgaaaggtaatatttaaaaaaatcattgagcatttaccgtatttaacaaggttcccagtttatcctctcttcttttaaacctgactttctagtacttgagattttctttattctttcctggttaggttaagtatgcctttaactgcttttttttttccttgcataaaggatagatagcatgtcgaatagttggaaagaatttgtatatgagataatagctttctattgctcctatacattgtcaagtgatcaagaatatgctgggtgctcattcttggttcgtagttttctttttctcaaaagagtggagtattttcattttcattattttttggtgtctgattatatagaagtcaaatttgaagcaagtccaatttgatcaagttcttttaacttaatttttggatacttgtagaattttttaaatcttgaaaaattattgccattattttaataggatttactttttgtttcttcataaatctatttttatggtagctcttgagttctaaaacgtcagttttctttagctgaggaaagttatttttcatttttttctatggtaactgcacttgttccattttgctgtctttttcagatttctttcttatgtgaatttggtctctcagatatgtttttcgtatctcccactcacaacattttgtcttgatcctgctgaatggagctcaagatgaattcctgcagttttctctttcatttggctttgctaataatttaacttagtgtttttgatttaacccttggtgttttccatccaatgcaagcatttcatcttcatgtttacgtttcatatttcatagaagcaatatgattatatgatgaatgccaataaatatttagttattatagtatacaagagataaaggaaggtaacaccaaaatgtttttcctacaattgtttcaaaaatctattttcttgactgtccctgctttcctgcacttcttctcgtaggttcactgattttcctgtttgctcacttggtttcatgcatgttgtggccggaatgcatgtttactatggaatgcatctctccactgtgtttggcagcaactcgaaaccccttcatttagcttttatgctggctgtggctgtctattctgagggaagacttaaggggaagccctgaaactatcttttctgcttcttgtgattacttactgatggaaaaggctcccttgatttaacttgtgttggctgttcctggtactggcctttgccttacagtttaaggatgctgttgaatattaacatattctttcaattacttcctatgagtgtctggagataggaagtagttgaatgttggggtgaatgatagaccacccacttctgcagggttccttgtgggtcttcaatattctagtcctacagaattccttgtactttctggttcttcatcagtaccttttctagatacagaccttgatattgtttgttttgttttgttttgtttgtttgttttgttttttgttaaattggtcaatgccatgcaactgtggtcagagggactgaaattgttttcacatggctctcttcactggaaagccctgggttaatctgctcatgatcctttacatccagctctggaatttttttttctttataatgcataatgaatagctttgctaaagaggattctgctttcaaatttcaagaataaaaagaggacatctgtctgagtattaacatgatggaaatttttaaaaatatcacatagtgtgttagctcatatgtgacaaatagataatgcatctcatggccattaggaacagaatatttgtcagaacattctgtctattgtttaaaggcattggtgtaatgtcataatatttctacaaggtatgaaaatgttgcactgtgcatgtctgaagtctatagtgtatcccttagactcttgccatttagctgaattctgggggaatgttgccagtatcgttgtttcaaatgagataatcaaatggcttatggagctctatttacccccattccaccctctgtcacaatatagtaagttacttattggagcatatgcttaatgaaaaattaatagcaatgcaatatgatataatggtgcaggactatattctgactagtataagatatttacatatttttgccaattggtcattatcttttatttcacatatccatgatgagtgcatatttagaaaatgagagagtgctttctgctaatgtttctgattattagtgatagtgctgaattcatatgcttacagagagactgagagggagaagaagaggggctagaggaaggaggaggcaggagagaaaagaaagggagagagaaaggagggagaggaggaataagagtgagaatgtgaattgctgtgtgggtgggcctgtgtatatgcaacacagatgcataattttggaagtctgcattttctatatcatcattttggaaccttaccaagtagtgcaaatgctgtgatttagttgaaactaattatgggtacctctaaaatggtatctcacataaatgtctcataggcatgatttgaaaaaaaaataatttgttattattcttccttgaaagtcatgtatttaaattctttaataaaatgggtaaggtttctgtgactagccaagataaggctgcttacacttatgaatctataagagactatacatttcctcactcttgcatgctattaccagatgaatcattctattttgtatctggcgactcattcatctgctaagagaccttctgggccccacagtgcctgcagtgcacatggaagctctttaggctgacattcagggtctcctgtgatatggtgcctctctaacactgtatcgcagttgacagtttgtgtgtgctttggcctccagctaagtcaagccccttgccattctgagttatgactgtgggatttctgccctccgtgcctgtgcagggtcactatgggatgtccttcgcctccagccttctatgtctagatgctgtgcatctttacacactcagctcagatgccttctcctccaggaatggtcaccgctgaggcatcatagttgttctccttttaacatgtaaactgatggaagcctttaccttcatgtctcctaagacagtgaaatgtgaagcctcagctatgtatttggagggccccgaattccaattagcccagttatgttgtctttggtatgacacctaatatctcggaggctccgtttcttcatctgtgaaataggggtgataatatgcatgtcacagggcttgggaaaatgaagatgatgtctgagtcatgtgtagcacagtgcttggaccataatcaatgtcagataagcgcagcatactctatgatttttattaagtgccattgctctctcctataatgtgatttatttgtacgtaatgtctccctagctgtggggtccctcatatttgtctatatgtctgccccccaccccccaccaaaggcccaacttttttttttttttacctcaaatatgcacaaaattgagtctttattttagtactcagaagacagtgtaattccagcccagtttcttccattatttccagtacctctgagctgagcaggtctgggtgatttgtgagtcttcatgtgtgataatgtgtagcctctacttcaactgtcttctaggtggcaagaacttctggcttccttccctgaagagaccagctgaagtttgaagctccgcactctcaaagagcttgacagttgcaaggatattttcagtgtgataaagggcgtagtttccattggctgattttaagaagtaatacacatggaatgtgattaaacttgtgtcttctgcttatcaaacaggtggacttttaagctaatctagagagttgagctggttagcatttatctacatttaatcagatctaatgttggatagttctacttagacatgtttctctatatgactctagacattccctcctgtggctagaaatcaacctctttataatcctgcctcccaaactggccactctgattctaggaactttgtggtatgctgttgtcttcatgtcctcaattctccacactgctgtgtagtgtggaccagtggacatctcatgggtctttggagtcagacaaactgggccgcagagtcgatgttgatattactgaacacttctcagtcacaatgtcctcatctgggtaaataaggctaatattgtctactgctaggactgttgtaaaggaataaatgatgcacaagtgttatgtgataaaacaacgtgtgtgatagatagaggacccaatgaatgttaatcatctcctctatgctttctctccttttctcacaactaaacatcatgagaaataagtctagccaaaaggataagcatatatcttaagtagggcttcccttttacctgtaaacatcctcactttttaaaaaacatagcatgaaaactttgtgtgtgtgtgtctgttgcccaggctggagtgcagtggtttgatcttggctcactgcaaccttcgcctcccaggttccactgattctcctgtctcagcctctcaagtagctgggattacaggcgcccactgatttttgtattttaatagagatggggtttcaccgtgttggtcaggttgatctcaagctcctggcctcaagtgatctgcctgcctcagcctcccaaaatgttgggtttataggcgtgagccacggtgcctgggcggcaaagtgtttttaaagagaaatacctttttagattccaaaaatatttactacttgaatgattattgacagtaaacagccatcatttacgtgaaaggtaaaacatgtgctttattttattttttaaaacatgttcttacgagacctcaaggctcaactgacacttttttaaaagagacagtagaaattgaagaaaacgataaaatttaagaagaacgatttctaaaacttatcccaaaatcattgaaagaagtacgttggtgttttcaactaagttattttgaagaattgagatcattctagacaatcacagtcttggccacatgagcagttaaaattaatacaacatggctatgataatgacattttattatattaattacagtgaaaatgtattgttcaagaaaatattttctctaggagaggtcaggtcattttgtaaaaaatgttcaagtttgtaatgagactacataacttcttatgtttgtttctttgggagtcgtaacaaaaccttaagaaatgagatcttcattacaaatagattcatatgtgctcataagaaatcaatttcctttatgcctttaacaactagcagatgagaataaaatggaataaaactatggttatgctttaaagtactggcaatagttttaacaaatgagacttcatttacgtcttcaatatatgtatattgttaatttattatctctaagtaacacagaaattcatgtgagtccagtgtagtgggagctgagacacagggagtataaactgaatccagacacttgcttcagtcaagtatttttagatagttgccttagtcacatgatccttgtctggacagtattaacttcctttgctgatatctattctaaatgatacattttgggaacataatcatgcctaacccagcagtgaaaccctatccaaacatatcagtttgaaaattggtaaggaagatgctggataataaaatgtagatatattttagttcctaatgagctaagttatgtttctggttgtgttttacaaattattcataattaccctttgggaattagtttacctaaactttaaagaacacacatttccaattatcaataaaatttaagtagcatagaaaaagattgtatatacatttttgaattgatccttccagaaatcttatgaagtagccgttcttatgtccatttggacagaaaacaattatggtatttagggaaactaagtaatgtatcaaggtcatgtatacagctgcttttttttttccttcttggccacataatgtcattttggagttgtgagccatggggtaacattgtcaggtttgtagcgtagattaatttttctggcagaaatgtgaatggtcaatttgtgagatccaagactggaagcagggtcatgtatcacccttagctcctatctttccatcatagcccatgtcccacacatcaggaaagctgttagctataatttgaacatgtatcaacaagtcaacttacttatgtaaggccactgcctgtatcttcctggcttcagcctgtcaactccttccttcatatacagtagcctcctaatttattcacaaaatgctccaaaatgaatatattaacttactaaccttacgactgtagcaaatactaacagttgagtaggaaatttacttaataggcagcttgaaagaaaattcaagtcaatgcagtacatttctgctgcaaatcatttctgttgcaaaattactccatttgattcttgtttttcagtggtcttgccagaacaaagttgctattctgggtttgttttttctcttttaaaataattttattcaatttatgaatttgtttcagtttttaatagaataccctgacaaacattgtatggaaattccaaactaaaactaaacaaacattgccgtgttttcaactgtttcttttttatactgctctgaagaagaaaacaattctccctgaacaaattcctattacaatgaaggcaaagatcatgttttaaaaatatttactgccactatttgaagaaaacttctaggattgttgttcgggctcatacatttttaaaaaaggaaagtgtaagagaaaaaaaaaaaaaaagcaaaggaaaggctggtcatggtggctcacgcctgcaatcccagcactttgggaggccaagatgggcagatcgctcgaggtcaggagtttgagaccagcctggccaacatggtgaaattccatctctactgaaaatataaaaattagctgggttttgtggtgggcatccataatccccgctacttgggaggctgaggcaggagaattgcttaaactcaggaggcagaggctgcagtgagctgagattgtgccattgcactccagcctgggcgacacagtgagactccatctgaggaaaaaaaagaaaaagaaaaaaggggaaacgaggaaagaaggaaaaagaagagaggaatgaatgaaaatggaaaatagaggacagggaaaaataaatgaaagcttaccttactacgcaagtgccctattttctacacataggaaagctaatgaattgttagtcttgttttttaaacttggaaaacttaagtcactttttttgtactgatattttcctgatttcaaaaaaagttacccaaattaagaagctaagaggaaaatgtatttccagttaactgaaatattaagttgagcaatcatttcatataggatctgcgttcatgtaagtgcatgtaaatgctctcagggtagatgtatgtttgggacctaataaagtttcctcctctggttttagaaacaggttaggatcacaaaatcatgatacaactaacaacttcaacaatcatcctcctttgtttggagcccattgcaaaacctcttcataaaattgaacccatacatatagtatgatgcttgcaaatctgaaaaatccctttttggacaaactaactcatcttgcaaaacttcctacctggagtttcctctcagtaatccttaacaggaccaaacatccctaattgtataaactaaagaaaattaagactagcaagacttcacattgaccccagaattatttctaaagttgccaaatacgtttttgtctttgtgtctgtagcaaatctcttactcttgggacctcattacctgagtcccaggacacctcaaacttctctgaaaagccaaattgccttaccatgggcctgtcgagaattcctgtccctcttcaatatttgtcttacctttgattcctgttttattcaactttaatgaatcctactgtctcttcatggacccactatccacacctgtggagtctgggaacgttcaatgtggtagaaaaatgtaaaatttttatttatataaaaacagaagacttgtaattcagcagctgtgcagtgtttttctagcaactgtgtgctcttttgcatttggtacagtataaacttctagtttgttctgctgtcatggaacatggtcccagtaaaccttcctgaggtcagcaacttggaccttctgctgtctaggtcccatgcttggcgtagtgtggataataatgttaaatattatatggttttggcttcactgagccatatcagaacattcacaaatagctgtcatacaaattcctgcttcttattgccccttttccactgtgcatagatgcaagaaaatagtttcatggccaggtgctctttgtttcagcttcctttgtttctcccaaggctgcatggcaaatgtatgatttgttcattcttttaaaaaaaattgagtgctaagtgccaggcattatgaatgtatgtatgcttggaagagggggagagcagtgttattatctaactcacattttgaaaagatcactctgattgctttgtagaaaatggtaaggggtgttgaggaggggtgctgatgtgtctggacaagtaaaaacattccctagttgtgattagttcaaaaggaagcttaatagtctaagaaataaatgtaaggtattagtttgaaaaaaggtcatgctgattaattgcatgtgcaaggggaggggaaaagagaggggagatttcttgatttatgggtaggtggccttgtgtttagttaggaacactgggagaggaatggctcatgggcagaatcatgagtttggaaatattatgtttgaggctcatttaagatacacaattggagatgtcaaacaggcaactgaatatatttaatatgagccttgatctggataattctttagaggagttaaacattggggtttttatagaatataaattgtatttaacctagtttttgaaagcatctaggatagaatacagattaggaagaggatgggttccaggactgagcccagagattcctcaggtaaagtaaagaaagagaaggtaggactaagagactgaggagtgaaccgtgaggttgctggaaaaccaggagactgtactgtttcagaagccaatagattcatgcattttaagaatgacagagtggccagttacattgaaggctgtttaaagtcgagaaggatgcttggaatgtgtccattagatttggcaacatggaaattgctggtaaccaaaatgccagagaaggtttatcagagtggctgctgctgttgaagccaaagtgggagtgatctgagttgctgatgggagtgtctgttgacctatcttttgagaagtttggctaagggcagcagagaaatagcatggttgatggaggggctacggggtaaaggaagttgctgtgccttaaaaatgacaccttagagctgggtgtgttggcatgcacctgcagcctcagctactccggaggctgaagtgggaggatcgcttgagcccaggagttcaagtccagcctgggtgctgtaaggatacctgactgaaaacacacacacacacacacacacacacacacacacacacacacacacagataccttagagcagcatttattaaaccgcagtttgtgaaccataagtggtcttaaaatatttttattgggttgcaataatcatttaaaacattaattggagtaaaagagaaaatagggtacatgccatgtggtaaaggtaagaattttatttttgtggactatattattatgaagaatttacaaatagttacatatctacacacatatactggtgtatattggattgtaatataaaatgtatttcttcacgtgaattacggttttaaaatttgaaggccatcaaactagggaatgtttgcatgctgatagggataatctagtagagagaaagaaactgatgacacaagagagtgggaaaaccaaaggtgtaaagtccttgagcagagtgaagaacttttcacacaatcttctctcttttctcatttatttaccatgtggcttccaggtagtcatcatcaatctaaccgtaactgaacaaatcccatgtttctgcaggtatgtgcggcagtgctgatgtttttgtcaacagcaatgatttgacatcagcactgggctttggtttaaattgtttcctctctcctttttctaaatgtgtatgttaaagttctaaccaccagtacctcgaagtatgactatatttggagataatgtctttaaagaggtaattatattaaaatgaggacgttaaggtgggccctaatccagtatgatcagagcctgtatgagaagtctggacacaggcaggcacagaagaaagaccatgggaagacgctgggagatgatggacgtctgtgagccaaggagtcttcagaagaaactggctctgcttacaacttgatcttggacttctagcctccaacattgttgagaaaatgaattgcagttgtttaagccactaagtctgtggtgttttcttacggcagccctagcaaatgagtacatactgtcatgcttgttatttgatttggcctttgattgttacaacagcctgaggtgtggaggaccagaattataaatgccagtttacagatgagaacactgagatgaagagataaatgactgaccgaaggtcagggatcaaaatagctagtaagtgatacacaaagtgttgtagatcttttccaagtgttgtttccttggcaaaagccttggtggcaggccctgtagtcatggcctgcctgtagtggtagatatgactctatgctggtccattaattagtgccaaaagctacatttctctgcaaatatagattctagtgtgttctgaaataagacttacaacacttaaaaacttaaggatgcctagtgatgaaatatattaacattttttaaccatcacttttatgtagcccatgaaattatacagctcaataaacatttgaaagtttagtctctcaatgagaagtgataaaatttgacccgtgcatgaaaagaagacagctgattctttaaagcctttttgaagagctatgacatttctgtaaacatgcaccaaggaatatctgaataaagcaataatcgatcaactaacattgtgttggtttcctgatacaaacacctgaagtgaatgataccagtaaagttaccatccttttttctgcaatgctttttaggtcattttaattttaagctacatgctcttaacttgaattttaaacttcttaatggaatgtacttacaatgaataaatgctctgagtgacacttagagtttgcaacacgtttagcatgttgtgctgattcactaacgtacgctttctttcagattacttttactaagtaaaagtagtctacccttacactggtgaataagacaatatttcaaaaaattcctaaggtaacatagaggaaatgtgtattttgtgtgtgtgtgtgtgtgtgtgtgtgaatcacctttcagtataatgagaaattttatttcaccttatgaaaacacatgagtttttttagcatacaaacttaaagatcaaatttttaggttgtacgttgtgtctgtcttcagctgtgtaatgctaaatagatcttcaggttaccatcttatctattatgcatttgattctgttttcccacattctaaaatcagtcagattattgatttttacaatctaaagaggataatatgttagctgattattttcataatttgtgatttcctgattattagtgagattattagtgagacaaagagatctttgacatatttattggccatttgagtgtcttatgtcaactgtctattcatataactagcctgtttttctatttatttttattttcttacaattgaatttatccgttccttttgcatgttgtatgatactccattttacctgtgagatttgtaactatcttcttccaacctgtggctttctttttactttgcttataatgtattttatcttataaaaggtttcagtattaatatgttcaaatatgtttatttttcttttatgcttttttcttttctgtttctatctttatatcatcaatatagtctctacgtaataatttgaaagttaaatatttgtttacctgatttaagttattaatcccatcagaagttactttttttgtttttgtttgtagataaggagttatctgattttttttctttctctgtatggttagccggttatttctgcaccatgtattggatagtctatcttttgctcagacatttgtcataggctgtatcctaagctctcattggtacctgagtttattttaaggtcatttattctgtcacttttgttcctgtgtctattccttaaactatatacactgtttaatttctgaagctttttagtaaaggcttatatcaattaagctaagttctctattcattcacagcaaaatttccttgacagatactgatctgtaacttttccatgtatattttagcaaaaaattgccatcttccttgaaaacactaataggatttggttagaattgctttgattttatatatttatttgtaagaattgccttaaggacatttgggcatatgagcatgatatatagctcgtttgcttatgtctttttatggcattcaatagaattattattttaatctaaaagtcttacctacatgtttactattaatagatttagttataactgtcattgtgctattataaaagtaactctttaaaatcaaattttcttttttcttttcttttttttttttttttgagacagagtcttgcactgtcgcccaggttggagtgcagtggtgtgatcttggctcactgcaacctccacctcccaggttcaggtgattctcctgcctcagcctcccaagtagctgggactacaggcgcacgccaccatgcccagctaatttttatatttttagtagagacggggtttcacaatgttggccagatggtttcgatctcttgactttgtgatctgcatgcctcggcctcccaaagtgctgggattacaggcgtgagccatcagtgcccggcctaaaatcaaattttctaacagtttgctgcagatgtgaaggaatattacatggatatatttagtatatagaaatcttgctgaataattttatccattataatcatttatttattgattttcttagattatgtgggtaaatgtggataaattatataattcttaattcttttaatccttctacattttatttttgtgctattttactgtagtagatattttcaatacaatgaagactagaagttttaaaaccaggatagcaacctcatgggcctatttatgaaacaatacctatttatatgctacaactttttcacctgttatcgtgaatgacaattgacatctaacaatgggaaccataaacactgttgagctctaaatgctttcccagtgcattaaaaaaattaaattgactttctttttcattctttttctctacctctctcagaaacaacttctattatttactcattattatcttattccctaatttttttattttattcaacagatacttactgattgctcaccaatttgccaggcacagctggttttggggggcattccatgatgaataaaagtagcaagatcccatttctcatgaggcttctggattaacaagggagacatgcattatatagaaaattacataatggttatttccttacaatccgatggttactctgaagcacaagtgtagcatgctgtcagagtgcttagaagatcgggagggaatagtgctaatacatagtttggaaggtcagggaaagacatctgaacttgaccacactattgagtatgagttcgacaggcaaagatgggaccttgagcatgtagaatactccagtgacaagagtagatgtaaacaaaatagctctaaaaatagtgttcagtgaaaagtgatttgctataaatattacataggtgtgctaaatagaaaaatagaaaaatgattgaggacagcaaatatctgttgaatgtccctatttggaaggtatttaatatatcactctgaattgttctctggttaattaggaaaagtaagtttaaccaaggggagggcaatggatgttggtacagagctattcaagatcatggctacctgtgtacttgcctcatgcaagacctgtcacccattggaacttccatcattttttctctggatccatttctggtagtctctttattttgatctctatttttccttggtacccatgaggaacacaatttgaataaaagaaaaaaatgtattcataatttagaaaatgattttattggacccactaacatcaccaggaagaatgcaatgcaatattggcggtgggcattttggttaagactgggttggtcattttaatacaccctttcagccagtattcagagcaaggcatgtgcttgcctagacttcacattttagaaaagccagggcctatatatggagagttcttttttgtcagtctcatgaaatgaagtgctgcagtttgcatttttcctattcagtttcaagtatgaacttgattttaaaatttaactacagtttcgttaagatgtactacaactcccagctaattatgtagatgtatcaaatatgtattttatttaaaagccgtattactattttgcttttatccatcaatgattcttggataaaaggtggtaataaaatgttaatgtgtatttagtcatatgcaaaaaagtactatagaaatttctgaggtgtacaatgacatgcattattgcttccataagcgtaagaaaactcagaatgacaagtctacacaagctaggtttcttgttcatccaggggtggcttgctttgtaaccttttcctgaatagtagactaggtactgtcttccttttatttcccctataaattagttgcagtgttcttggggtccttagggacttcaggtggttgagcctttcaccaagcatacatacctagtctgtgaacagaagtctaggactctggaaagcactgagggcagagatgcttccagtcctgtccttacacgacttcccctgccaacctcctctcttccctcaggtatttttcttagtgcgttaaagatatttccttttacactaaaggaagtccagtgaaggttgcacagtgtgcagtggtgcacaaaaacaaaaacacaaaaaagggatgcatgcactctcaatagaattttacatggaaattgggagaagaggactccatctttctaggggacaataatggacactggccaaaagcagctgagtgagagctgagaccaaatccctgggatcagacctttcagccccagccatgcctcctttgggcatttgccttgtggaagactgacagctcctcagtcagtatagagggccagagacacagcgcagtatagaagcacatgtattatgacctggtcatgccaccaatatgtgagctgtgcttttctttgacatttttcattactcagtgaaagaagtagaagccatgcttgtcttttctctgccctggagaagtggagataacaagggctcagcctcatgagatctgagatgtagggcagactgtgtccacaatgcagaacttcagtgaataattaaaaatgagggcactttctaatggtctaattgagcacacggtgaaggaatttccaataagttatgtttaaccatcaagtgacattataagaagaaagaatttcatctttattttataggtgagaaagctgagccttggagtgggtaagccattggccaaggtcataaacaagtgtgtccaattccaaacctaagctcataatgagtacactgtgctgttgtaaaaggggccgtctctccctctttcagtcttaatgggagaaatatttaaaggcatctttgtgagaaagttttctgcaaaatataatgtggtttgaaaaatatgagttactgtgttaggttcagattgttaagactttcttttaatgtagaaggtgtagtgtctataaccattaatttgtgttgcaccctcccttttgtgaagcttattaataaaacagtctgctactccatcctccaattcctgtacttccagtgttcaagtctgctgatcatctactgcctaaaaagttttcccataaacaggaaaggttccagaagtgactttatcaacaaaaacgctgcttcttgctgctacaatttcctgaattacaaggcacagatggacattaattggagcgggtgttttgagagccagcactacctgcctcacactgctgagggatatagaggtctctattcctttctaagcacaggactcaggaagtattctggaagcagctcagaaactcagggtcctgcagggatgtgcctcttttggaagggcaagaaacctcactgatgaacagaagcccctcaacttcagattgcaacctcttcttgtgacacatgagacgcttcttaagatttcaaaacaaaacttggtttccagagggcagctagtgagctcatcctgtttggagacccaggctgtgtcttatctgtgtcaaataggtaatattttgacagaagtgtttccaactagcccacctcatacatagaatattgtactgcattggtctgttgtcatgctgctaatatagacatacctgagactgggttatttataaaggaaagagttttaatggactcacagttccacatagctggggaggcctcacaatcatggtggaatgaaaggagaagcaagccacgtcttaaatgataacaggcaagagagcttgtttaggggaacttccatttatagaagcatcacatctcatgagacttattcactattacaagaacagtatgaggacacccacgcagcgattaagttatctccatctggccccacccttgacaaatgggattattacaattcaaggtgatatttgggtggggacacagagccaaccatatcattccacccccggcccctctcaaatctcatgtcctcacatttgaaaacacaatcatgcccttccaacagtctcccaaagtcttaacttattccagccttaatccaaaagtccaacagtccaaagtctcatttgagacaaggtaagtcccttccacctatgagcctgtaaaatcaaaagcaagttagttacttcctagaaacaatggtggtgcaggcattgagtaaatgcccccattccaaatgggagaaattggccaaaacatagagactacagtccccatgcaagtctgaaatccagcggggtagtcaaattttagagctccaaaatgatctcctttgactccatgtctcacatccaagtcatgctgacggaagagatgggttgccgtggtcttgggcgtctccacccctgtggctttgcagcatttatccacctttccagctgctttcagaggctggtgttgagtgtctgtgtcttttccagatgcacagtgcaagctgtcggtggatctatccttctgggttctggaggatggtggccctattctcatggctccactaggcaatgccccagtggggactctgtgtgggggctccaactccacatttcacttcccacactgccctagcagaggttctccgtgagggcctcgcccctgcagcaaacttctgcctggatatccaggtatttccatacatcttctgaaatctaggtggaggttcccaaacctcagttctttacttctgtgtacccacatgctcaacatcacgtggaagctgccatggcttgggatttgcaccctctgaagccatggcctgagttgtaccttggccccttttagccatggctggagtggctgggatgcaggacaccaagtccctaggctacaaagagcagggggaccctggtcccagcccatgaaaccattttttctgcctagggctctaggcctatgaagggaggagctgctgtgaagacctctgacatgccatggagacattttacccattgtcttgacaattaacatttggctcctcattatttatgcagatttctcagctggcttgaatttctcctcagaaaatgggtttttcttttctatcacattgtcaggcagcaaattttccaaatttttatgctctacttcccttttaaacataagttccaactccaaaccatatctttgtgaatacataaaactgaatgcatttgacagcactgaagtcacctcttgaatgctttcctgcttagaaatttcttccaccagataccctaaattatatctttcaagttcaaagttccagagatctctagggcaggggcaaaatgtgaccagtctgtttgttaaagcataaaaagagtcacctttgctccaattaccaaaaagtttcttatcttcatctgagaccacctcaacttaagcttcattgtccataccactgtcagcattttggtcaaaactattcaacaaatctctaggaagttttaaaccttcccacatttttctgtcttcttctgagccaactaaactgttccaaactctgcctgttacccagttccaatgtcacttccacatttttgggtatctttatagctgcaccccactctaccagtaccaatttaatgtattagtttgttctcatgctactaataaagacttaaccaagactgggtaatttataaaggaaattggtttaatggactcacagttcctcatggcttgggaggcctcacaagcatggcagaaggcaaggaggagcaatcacatcttacatggcaacaggcaagagagcttgtgcaggggaactctcatttataaaaccatcagattttgtgagatttattgactatcaggagaacagtatgggggaaaccactcccatgattcaattatctccacctcgccttgcccttgacacatggggattattacaattcaaagtgagatttgggtgaagacactgagccaaaccatatcataaacttatatggcatatgatgggaaacttttatttttccatcacaagtagagtggtaatatatacaaagagaaaatgggtatcaggtattggcaatttttattttcattgttcatttacatatgaatttttagtataaatttggagactttaagtattcatgtcagaaaaaaatatttcagtgaataagtttcagaaattcaacgtcgtatgttttttttcttttgcaaggtcagactgtagattcctttaaaaaaggactttttattgatagaaaatgtgtttatagaattttaaaatagtatattctgttcattatctctaattttctcactctgctatactacatgcaattatatgtctaatgttatttatgtttatttatataaatttgctgttaaaatatattcaattccctattcctctaaaaagaacaaaaataatgacaatttattcgtattttttttcttggctatgaactcaaatagatgaaatgttatataaattaacaaactttaatagcacgtattggtgatgtgcaagtcaatagttctcaggcatttaccttcctagcactttcctatttgctgagagtagaagcgtttgggagaaatatacaggatagtacatgcttttcaggaactcacacctagctggaagggcatacctaccacagtggaaacagtcagagaaaaatccatcttggaatgtgggaaaatgattgtagctcttgaggaatttagaaagggagagatctttaggggctgggaaatgacaagttactaatatgtagactgggcagttcctctgtgctacttccataagcaagtgctttatactcacactgttgcatgtaaactcctcaacatttctgtgatagaggtactgtgagatgttcctttcacagaagaaactgaggccaaaaaagtaatgtgacttacccaaggtcccacctgtcataagtggcaggctcaggcctcatttacatggaattggtgtttttaaccatctctgttctctttgcagtggttgtaagtgcctcggcaataaaatagctaaacaccatcacagagtgtatagagttctcatgggctaggcattgtttcaagtgtcttttcttgtgttatctcacttcatcctcatataagccctatggatcacagagaattatgtgccttgcctaaatctgtcatgcaagcaagaaagatttgtgttggaattgaagaacgggcatgatgttgatgaacatttgggatgaggcacaagtgtttgaatgggctgatctctctgaaactggcagaggcagggtgaaggtgctggcttcaggcaggaaggaggccagactgtagggcagattctcatttttgaactaaaggcatgcagtaggaaacctgagatttattcagaggagcctagaaataacaggctagaaagaggaagggaggaatggagagcccttagacaattgaaagactaaattggccagcaaggaacagagatttcccattctacaatgggaaagaaagatgtggtctaaggtctgtgttaatgaagaaatgctggattctgcagtaagctttctgggagtctccactccataagcgggaaatgtaggaatttgtatgctttaatcaagtatatttctcaagaccacatcagaagtttttcttttgtagagtctgcattgaaatcatcatatagtttaagaaactcacttcgaggtagggacaacaatgttgtagttagcattgacttaaaatgtgagaagcgcaaatgtaaaaattcttacttgggttctctaaaaaagaaagtatgataattgattaatgtatgagcagatgaaccttcaccagattttgaaagcaaacctttggaacatgtaatgtatttgaagatacttttctagattttcccacaaaggatcttagtgaactgatcattcatacttcaaaatagaatttgagaataatactgtttgcaatcaaagttgggaacaaatctcatcaatatgattgggctttgtgtccccacccaaatctcatcctgaattgtaatccccataatccctataatcccaacgtgtgaagggagagatcaagtggaggtggttgaatcatgggggtggtttcccccatgctgttcttgtgacatatggtgaattctcatgagatctgatggttttataaggggctctttcctttttgctcggcacttctcctttctgccaccttggaagaaggtgacttaattgacatgtgagtcaattaaacctctttcctttataaattaccgcatctcgggcagttctttatagcagtatgaaaatgggctaatacatctgtcttcactatttactagttataaggctagtaaatagccatatgactgtatggcataatttaatttctctaaaccttagttttcttatctgtgaaatgggttaataatacctacatcatagaagttatagtgtattaaaaatagcacatgtaaaatgatgaacatgaagccaggcacatgtaagcaatctattaacattatcatcattttcattgatgttccctatagagacagtcatctgtggatttgatgcaggcaaactagatacctttaataaaaatatgaggtagttagcaactgcaaaggaaccttcttattcagagctattgttactgtcagcagtgttaatatattaattttgcttggtcattgactcagtgtataaaatatgtgggcagtgaactgaggaagcttagggaccagtgtgaaaaagacatataaatcatattaatgcagtagaagtgttataatcaagtgtatttttaatggaagcccatagaatgtgcttttactgtatggttagctgagtggttagccgattggagaagtgggcaggaaagtgacatttgagtctagatggatgagtaagagtctacttgaaagatgagagtccaaggaggttgcaaacagaaccctctctgccaccagaagcatgaaggtacaaagaaaatggcaggcagtaagcatgcgagatgttaactatggaaagagtgtggagtacaagacgagagaggcatgagctaaggctcaatgaggaagggcatcatttgttatatttcacatttatttgccataaaataggcttaggacaggtgtcttgatcgttaagtgcaaaagtcacatgatcaaatttatgtttcagcaagatgatcagagatgatgcaaatgaaaaattacagggagagaaactgaaaaaatattgttatgttttaagtgaaaagtaatgaggtctgcgactaggcaaagacatggaagataaatggttgggaattcaggtggaagacttttgggaactgcaagccattgaattgtttactgaatgtgggaatttaatagcaagtgaattatatgtccacatttgaccaataaaacaatagtgacatccttagaatcaagcaggaaatgcaaaatgaaaagcaggatttctttgagcatgtaagggaatttaattctcaataatttattgatttatttttattttttatactttaagttctagggtacatgtgcacaacgtgcacgtttgttacatgtgtatacatgtgccatgttggtgtgctgcatccattaactcgtaatttacattaggtatatctcctaatgctatccctctcccctctccccaccccacaacaggccccggtgtgtgatgttccccttcctgtgtccaagtgttctcattgttcaattcccacctgtgagtgagaacacgtggtgttcggttttttgtccttgggatagtttgctgagaatgacggtttccagcttcatccatgtccctacaaaggacatgaactcatcctttttaatggtggcatagtattccatggtgtatatgtgccacattttcttaatccatccagtctatcattgttggacatttgggttggttccaagtcgttgctattttgagtagtgccgcaataaacatacgtgtgcatgtgtctttatagcagcatgatttatagtcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatcttttcatgtgtctgttggctgcataaatgtcttcttttgagaagtgtctgttcatatccttcgcccacttgttgatggggttgtttgtttttttcttgtaaatttgtttgagttctttgtagattctggatattagccctttgtcagatgagtagattgcaaaaattttctcccattctgtaggttgcctgttcactctgatggcagtttcttttgctgtgcagaagctctttagtttaattagatcccatttgtcaattgtggctttttttgccatagcttttggtgttttagacgtgaatttcttgcccatgcttatgtcttgaattgcctaggctttcttctagggtttttatggttttaggtctaatgttgaagtctttaatccatcttgaattaatttttgtgtaaggtgtaaggaagggatccagtttccgctttctacctatggctagccagatttcccagcaccatttattaaatagggaatcctttccccattgcttgtttttgtcaggtttgtcaaagatcagatggttgcagatgtgtggtattgtttctgagggctctattctgttccattggtctacatctctcttttggtaccagtaccatgctgttttggttactatagccttgtagtatagtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcatcgaatctataaattaccttgggcagcatggccattttcatgatattgattcttcctatccatgagcatggaatgttcttccatttgtttgtatcctcttttatttcgttgagcagtggtttgtagttctccttgaagaggtccttcacatcccttgtaagttggatccctaggtattgtattctctttgaagcaattgtgaatgggagttcactcatgatttggctctctatttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaatcgaatacactttttttctttctcctgtcttattgccctggccagaacttccaacactatattgaataggagtggtgagagaaggcatccctgtcttgtgccagttttcaaagggaatgcttccagtttttgcccattgaggatgatattggctgtgggtttgtcataaatagctcttattattttgagatatgtcccatcaatacctaatttattgagagtttttagcatgaagggctgttgaattttgtcagaggccttttctgcatctattgagataatcatgtggtttttgtctttggttctgtttatatactggattacgtttattaatttgtgtatgttgaaccagccttgcatcccagggatgaagcccacttgatcatggtggataagctttttgatgtgctgctggattcagtttgccagtattttattgaggatttttgcatcaatgttcatctgggattatgatctaaaattctgttttgtttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggaatttttttggttggtaagctattaattattgcctcaatttcagggcctgttattggtttattaagagattcagcttcttcctggtttagtcttgggagggtgtatgtgtcgaggaatttatccatttcttctagattttctagtttatttgcgtagaggtgtttatagtattctctgatggtagtttgtatttctgtgggatcggtggtgatatctcctttatcattttttattgtgtctatttgattcttctctctttttttctttattagtcttgctagcggtctatcaattttgttgatcttttcaaaaaaccagctccttgattcattgattttttgaagggttttttgtgtctccatttcctttagttctgctctgatcttagtaatttcttgccatctgctagcttttgaatgtgtttgctcttgcttctctagttcttttaattgtgatgttagggtgtcagttttagatctttcctgttttctcttgtgggcatttactgctataaatttctaaaggctttcaaagtaaaaaatttgaattatagcacaaatgtgtcattttagaaaatgccaggtttataggaaaaagttataaattgtaaattgtgattttatcttactgtgtcaatcagaacagagccaaagatgtggcttgcaatttactttaagaaaagaaatcacatatttgtagaatattttgtaattttcacttctcctttccataaactgccttgtttaattccttgaagagtctcactattctttcctttatgagggttctacaaatgtcccttaagcaaacactaggtataaggaactgtcctaggttccggaaacacctcactctcacagaggatacattctagggatagaataggggagttataagtatctagaatagaaagtcttaacttgggccctgagtagtatttggggatagtgaggtatacacgatctcaataaaatttacgtaaaatagttctaagaagagacttttaccagatttcaaagactttcataatcctaaactggttaagaatcatggttttcaaagctgagcctcaaagaagttagctgacttgctcaagttcccaagaatcaagttacaatttggatcttaatgtactgtgcagtgccattcaacccctcattgctaattgtcttgccatctttatctccaaagaatggtcaattttcctgagttctaatacattcctcagtttacttattataaatgtcacttccaatccggttgcagcaattaataattttgtaatatagctggatcgactttaatttcttttggctttaagtgcagagacatccaatcctgctagttccaaaggtgttttctgaaggcagtgttcccaaatcactgttggaaaggaatatggcaaggctcctgaagaaattccggtggaatttctttaatcatctggtggaagtggagatgtgtgtggttcctaagaatattgtgagtcctatatttaggacacagaccaatgcctttgaaatggccttcttggcttcctgcagtgtggagctgtgatctccatggtgagatatcccttatatttacacactgccacctgacctttgggtcagggcatttccaatcgatttaggagtgcagcaagtgcaacgacggtgttgatgagctcttacagcatggtaagcaaggctgcctgggactgaggggcgtgggaactctattgatttttaggtactttttatcacatactcctacactgctggactttgaattaagttagttttcagacaacataccagagggcaagaaaacaaaaagtgggatttttacacataccctggaaacaagttaatttttcctggggaaatcaagtagagagctggttaccatcttagcaattaacagaagttagacaaaatgtttaacaggaattggctttgtggattatggcattgggttaccagaacagcaatcaaaatgcacctcagtagtctcagtttgttagaactgtgtctcacttcaaatataactttgctctggaagaatagagagtctcaaattcacttgtgggatcctcaagaattttgcttctctgattgccaagcattgaagcaataatttgttattgaattgaagcaagacaacaggaagataattttatatcagcctgatggcgttgtttactgaaactctaataagcttttgggcatgtagtatgtgtgtgtgtgtgtgtgtgtgtgtgtgtgtgtgtgtgtgtgtgtgtgtcttgatttagggttaagtcttcctgatttgaaggaataattttaaataatattgtcagcatggccctgtgattcaacatctgttgctgtgttttttcctaaattccagtcttttgtatacacttagaaatttggatgatttacattggatgcttttttttttctgctcacttttaatctttacagtattttctgaaaggcagcatcaaattctgaatgggcatcactgattcatttacacatctgttaaaattttattgagcacatactatgtgtggtgtaatgcactactttccaatgataaggaatttagataagcaaaatgtgcttcaggtcgtcaggccacggtgattataatttggagagactgtaggtaggcaactcattacaaatgaagcagaatgaaactatcactaaattgagtaggcaggaatagcttactctggcagaaggcacctgagaatcctaattgagggaagacttttaggttttaagtaagcaaatccaccactgggagaatgacaaaccctgtcagtcacatgcctttattatcatggctctgctttcagtacctcccggttgtgatatctgtactcttctctctgctcatccaaaaagtctgcattatttcatgttaagagaatagtttgatatttactattggccaaagcaagaaaggctttgcctactccatgctatagcttagtatttgtggtgtttcttcattattggtgtacttctctacaggatttctttatgatggtttctgtctttagatactgacctaaattattacttgccctggccttttggggaagaaagtcataaaatcaactatgccttagatctgcattgtcaaatcggaagctatcaaccactgtggtcaatgagcacttgaaatttactagtcccatttgcaacatgctgtaagtggaaaaaacacactgagtttcaaagacctggtatggaaaaaaatgtaaaattttatttttatttttatagtgaatacaggttgaaatgctgagaactttatacatatatctatttaactatacatatatttaactaatcaattttgatttattatatataaaaattatatatatatttatggggtacatgtgatattttgaaagatacaatgtgtaatgatcaaattagggtaattaggatattcatcacctcagatatttattctttctttgggttgggaacattccttatgttctcttccagctatttcaaaatataggttaaatttattcataagttttttttttgttatcccttataaatgtgattgctctcttgatttcttttagagattctctgctgttggtgtattgacctgatactgatttttgcatgttgattttgcatcctgccattttactgaattcatttatcagttctgctagtttttttggtggagtctttaagtttgtctaaatataatatcatgtgtgaacaaggataatttcatttcttttttcacaatttgggtgtcctttatttctttcccttgcccaattgtgctggctggaacttctggtgctatgttgaataaaagtggtgatggcaggtatccttgtcttgttccagatcttataggaaaggcttgcaatttttccctattcagtaagatgttaactatgggatttttataagtggtctttattattttgagatatgtttcttctgtacacaatttgttgagagttttcatcataaatggatgttgaatgtaatggaatgctttttcagcagctatgatcatatggcttttgttcttgattctgttaatgtcatgtatcatgtttattaatttacttaggttgaaccatccttgtatccctaggataaatcccatttgattatggcaagtcaatttttttaacgtgttattgaacttgcatgatggaattttgttgaggatttttgcatccatgtccatcaggagtattggcttgtagtttccttcttttgttgtgtctgtgtctggttttggtatcagggtaatgatgggcccatagaatgagtttgaaagttccccttctcttcaactttttggaatagtttaagtagaattgttattgcttcttctttaaatgttttgtggaattcagcagtgaatctatcaggtcttgggcttttctttgatgtgagacttttaattgtagcttcactctcattacttattattggcttgttgaggttttctatttcttcattgttcaatcttggtaggttgtatgtgtgcaggaatttatccacatttttttaggtttttcaatttgttggcttatggttgttcagaatatcctctagtgagtctctgaatttctgtggtatcagttttagtatctccccttttcctctggtttcattgaattgagtcttgttttcttaattcgtgtagctaagggtttgttgattttgttcatctttgcaaaataacaagttgtatttgttgatcttttgttatttttgtatccttaatttcattttttctgctctgatctttattatttcttttcttctactaattttggaaaacctttatacagtgggttaaagaaaatatcttattaataattaatattaatttcacctgtttctttttcctttatttcacatggctaccagaaaatttaaaagtttacatgtggttttcattatatttctgttaaacagtgctgcctaagatagtgcttatggaactgttgtcacaaaacttatgtataagtgggttaaccgagataataaagctgaattcaaggtgtgtagaatgagcactagactgagatccagggactgattcagtcccagctaggacttggtctcctcaggtagccattcactctacgtgtctggaatggagtgcactcactgaaaaaatgcggaaaagattgagaagtagatcatttctaacccccttcctacattaaattcagtgattcaactgtgttcaggagtatacgattgaatcatacttgtagccctcccagtatcttctcaaagccttttagacaaaaccgtcttcctcattccacatcataatttatttgagaggttaaatttgtaattactgtaatttggagcttccttgatcagcctgaggctggagcacagcatccttcaatctgttcagtgctaagtgaatcagttgaacatgttgtgatttataaggatctgataaatatgttttgcaagaaagtttccagcactctttgaaaaaatttagagtgttctgaaagtaaactgtagtttttatgtcatttcaaataattaagaagaaattgtttcttattttttaaattaatattgaaaaatctatttctaacttaaattcacaggtaaaaaatgtggaatacttcatatatttcttataatattaaatatcttattaatattttatatcttacactttgatataaagaaatataagaaatatatataagaaatactctagccatatctgacttttttccatgtacgtatatttgaatataatatagattgtagtgtatatgttttagttttttaaaaaagttttaacatgtgttctactttggaacatgagtaatttataatattttttcttataaataatagtatgtttacatgtgcatatgcctgagataattagtttaggatcatttcttaatagagaaatgctggtcaaaggacataaatattttaagattttttcatatttataataaactttccttccaggaagtttgtattttccatttgtgtttcccttagcagggactgcctgttccctgcaaccttaccaatactaaaattaagattttaagttttgttttggttgacgagtgagaaaacatactttatttttgttggaatttatatttcttaggttactaagagaatccaaaattatttaatgagcatattggcaacttctaattcttctttgtaaatagcttgttttgggtttatatcgtctatttacttacttattttggatagttttttgttttgttttgttttgatagctgagctggtgagattatatagcacccttgaaaactttcctctttgctctgacttccaatcctgttcagtcatagacagccctgcccctgctccatccacatgtcacctgagcaaacaagcatatacaacagggggaaatcactgtagtcctcatcttggcatgtgggttccagaaaataatcaagcccttataagaggaagaagataatttaactcccatttggtccttatattggagtcttttagagcaattttttctagtttttcctttccaaagcaaatgaaaagaccccataacaatactagctttaagatctctgctgtaaacaaggattctgagtcaattgggataccacaggttagttacgtgtacactggtgtatccccttgcaaaatcacctgccttgagctgtcattacagaaccattataagaaagggccatataaaatataaaatattttaataaattggttgtgaaaatattgttatggacactgttttgtataacactgacattccaatacacaaaggatgcattataaaagatggagtgctagaaaaagctaaagtgctcttcaggtttatcttgcttctgatacgtgttactgatgatgtttcgggaattgcttgtctgcttggaaactcagagccaaatttgattcttaatcacagcaataatattggctgttagtattgactattttggtaatgtatttttatgctccaatttatatattacctataatttctgatttcattatttggtaaatttttttgtgtggatttttgtgtgggtgtgtttgaattttgtctgtctgtttgtctgtttgtttgtttgtttgtctgaaggtttttggaaaccttcttatttctgaaaaagagcaaggcctgtgattaagaagagtttttgcaagttcagtgaatactgtcatcattttcataataactttaaggtttattacagaaaactagaatagatttttgcctcttcctaggcaaaaaaagctgttgttcccaagcagaaaggtgaaagtcatcttgtattatttcttggcttttcatttttatatatgtttgcttgccttaatgataataatgctctaatctaattatcaatcacctgtttaatgctattatttctgttaattcatgggggcagctaatgattttaaataaggtagttttcacaagaataagtgaacaacatgaaactttttgtcaaatcaattttctaggcatcctttattttctgggcatcctttgggtttattcagtagaatagtctttggaaaatttgtaaatcatgcaataattgaaataaccaaaatactgtctccttatacacattttacataggaatatgctttagaaaactaagcaaagtataagtaaagggaatattacagaaaggtaaatgtcagtgttcttctattcaaattatgggctttaatttccccagccttttggtggtaagtgaagccatccttgtcttgaaaactgtagggggaactgtttacatggcctactttagacccttatgttattctgagtttttttcttctccagggaaataatttttaactatgtttgaaagaatgaatttaaggcttattaactgaactcgtcttcaaaaatttagaaacgatggttctgtcaaatcagataattttcttcctgtgcattaaagcataatatgaggaaactattagctacaaagcacatttaaatgctgcttggatattggtgtgcccttgctcattttcttgagtgtttctcaattcaaaactcaaaattaactgcatacttggcatcaggtcttgccatcaggttgaacctgagctgatgtcaatgacacactgctttggagcccatgggtaggtgaggggattgcagtctctcttcagtgtgggattctgaaaagaggcaaactgatagaggctccaaccaaataactgtacccacacattgagggactgaaggtaaactcccagagaagagacaaagacaggaggtggagagcagaatagtcaggaaacaagttagtcacagactttactcagatccgggttgtgcaagcaatgcagacttgactcttttgtcccatccactactcactgcccactgcactctttttggctgggttgtattattaactgctgggaatatttttctcaacttccattagagtggggattctcatatgagtagtagtaagtagaatagtaggaagtaagtaagaagagtagtaagtgaaattctgaagtactacctcttcctgcttttttctactggccttaaacatggatgcaatgtctggaactgcaatgattatcttgtaaacatgaacaagagatgacaccatgcctaggaaacactgaatttctgcctgcttccagacttctggtcataggaggaaaaaacaaaacaaaacaaaacaaaaacccccattagaagtcaaaatttctgctacttgagttcaaatgcattcctaacttatatactttgttgcctcgtttgttgccttctgctcttcaatagtctcactctcattggggaagaaaaatatataaacttaaagttcttattgcgacacttcttaatacctaaaattgccatcctgttgagccaggatgatcctcacatatgaggtacttagtagttgcttgttgaatggatgtgaaaaatattcctgtttttcactttggccaaattgaatgatagaaacgctttgggcttctctgacctggcagttccacagtgcaaagcaacattctgccctcagatcagcacacatctttacttatacaaaccctcactctggggtgcttattgttatagaaatctgcttctgtttttggcttccctgatggaaggaaaaggatgcctcagttcctggatgtattgtatgaaccttggctatacttacataaagcacaaaataactaagaaatatgctcaccccgtaaggatttatgtggagctcactcacaaatactttcataactgctgagaatcagcacggtttggtgcgatgttgaaaagtcatcagaatcaaaaaactatgtgtccaggtgcggtggctcacacctgtaatcctagcactttgggaggctgaggcagatggatcacctgaggtcaggagtttgagaccagactggccaacatggtaaaaccccgtttttactaaaaatagaaaaattagccaggcatggtcgtgggcgcttgtaatcccagctgctcgggaggctgaggcaggagaattgctttaacctgggaggtggaggttgcagtgatcagagatcgcatcactgcattccagcctgggcaacagagagagactgcatctcaaaataaaaaaaagaatcaaataaactctgatacccatcgttaccaccattggctgtgtgctgtggagaaatttagttaacttttctctgaagaagtattccttcctttgtaaaaatagacataaatatgccagtttcccaaagtgaatgggattaaattaaatcatgtatacatatataaagtgtttggcatgtagtaagggattaataagtgatacctgttatattaatggttgtggttatcttgcaatatgatagttgaaagatgtgctgattcaaagctgtcaacccaacatcttcctgggatctcacctgccttgctgtattatctgctggcgtctccaagggtgaccagcttgaacgatttcattatgtgtcactactacaacattttacacaaatacaattaaacaagttcgtcttccagcacactagttgggagttaaaaacagtttctattgatttatatttttgatggacttcattgagaatgttctgatttgtgggttaatgctttcttacattgagggttcccaggagccctgcagtgaagatggtaacctttacctaaactcaccagaatgattaattaatgtttacctctaatgagctaattaggagtttgggacattttggcattttgaatggcttacttgattatctaaagggaacttttaccatctcaagaggaattataattggccttagggaataatagaatcacctaaagtataagaaagcctccctcatgttggcaaacaacctgtctaacaaatgtcccctttgacaaaacagcccgcagtcacaaatacgagttgaaatcgtaaggggaactctgacaggatttacagttacattaattgctcgctcttggcatgggtgatttttgtgattagaagaggatcagagcagctttctactcaagtctttggcttgaggctgatcattctccataaacaatgacacctttgggagggcagccaaaaatgtcccatagagaaatatcaggagagattcttacttaatgagatatgaataaggctgttgagctccaccagatctttgcttgtctccttaatgaggaaacatcacagtgggtgaagtggtgataatgttaataaccatgatccaattcaatgaatggtggaagtaaggagagaattcaggaaacagacgtaacacaactctctatacaaacctctgggtcagttatgtaacttgattttatgtttatcttcaagtgagggagttagtgcgcctggcttatgcagtagttacacataagacatgtagatggaagtctaataagtgaaggagactaaatagaaagtcagatgtacctcagggagaaaacgtgattcataccaaaactcactctacggagtgagagagctactcagcactttaatggaggatatgatcaagacttgattttccatttcgttttcctttttggaattatgcacttcccaacagaaatgtctaatttggaaaaaaaaaaaagggacctccactgtcaagttgggggaatgagggcaggaaggagaaaatgaatataaaagaaataaatgaaggacaagtttgcaaaaaataggttgtgcaagaaccaagaaggtttaaaacaacgttcagagtaatgagctcaattcactaggaatggggagttcttgaaggaattgaagcaaggagattacctgattagagataggttgcattttaggtaaaggtagaaataattattggaatttagaaaacctcccaaaatacctgattataaaatcaaagttattatctagatattcaagtattaaataacttttaaataacctgaaacacatggatcttcacatatgtgaagaaagcattttcccagccacattcattatccgtaaaacattttacagtacctgtcatagaagacccgtcccatttatatataaagtttcatcggtgctctttaatgtcacattattttaggtatggttgtttcaactgagtgcacacatctattagtgctaagtcacattggataatgaagcactgttattcccacgaacctgtgttaggtggaccagggattttaattaaatatctgaatgagtgttgtaaagtggatactctctagaaagcatctgtcagggttaatactttacaagttagctatgcctctttcaacctttaattataatattctaactctttatccttagttactgctaataatttcaaggttatacagatagaaattacttgattatccaagtgcctgcacttatcgaatgaaatagaaatcaatttcactgtacatggtttataagtaagcaatgctaacatattattgtatttttctaaaaaaattctttttttaacaaaaggaattgaaaaccacatgatatcctgtggttgaaagtgcctaatgcctgccacatatgtaacaaaagtaaattcttaataataacagtgatagtcctcctgcatccaataaacaaacgcacttcttgatcattgacaattcttcagctctctttaagcattgatctttagtccttattaatttctcatagtgtcctgcttggcccccataagtccatttcatcatttaagtatatggccttgccacttccttccccacaagtagactttggccatttctatggatgcagcatttagaaaagatttgctttagcccttaattttcagaatcataaagcacatcaataattttttcacctccaagccaccccttcacaccaccttcatgtgggctgaccaagcagtgggccattcaggagtcaggcagttgctgttccttgttaggagaagtagaaagccatgaccccagcattgatatcaaatcttttaaatattggttatggggtattttgacttttatcttgtttgattcttttttttttttttatttccaatcactgttttgataaaaatgtgttaattatatgcttctgtttaagagtcatgatgttactcttctgttgatggacctgcaaacttcatttattataagacaatgagaagttattattctccctaagaaagctagcttagcattcattttaagaatactgaagaaaactttgattctctaactagaaaagagagattaaaagtatttaaaagtacaaaggaagttttttccctctcaggcctctcttggttcctggtttgttgttgttgttgttgttttttctaatgctgcttcagttaacaatgccttgtgctggtatgctattttttaaatgcaatggagggaacagatagatcttcattcttcctaagagtagaaaattctcattatggagactcataatcttcaatatttgaagactatattcacaccagatcagaataatgataagttaagcagaattgaaacatattgaaatcatatttgacactggaaattctttaattctatgagaactatatcattatagttctcattttataagaaagttatttaatatattttaaggatgataatagcacattgtgcgttaactttgatgtctctttctttgacagtttggagactacattggcttgcaatggagaataaaatctcaaccatattaatgggatcatcttttattctccaaggcctaagtagtttccagggcacatgatgccccttatagatcctcatttgtccttacagtgtcttcattctggaatgtgtaactaaagtaaattccaaaagtaaatgttaaagaatcatttttaaaaccaagtaaaataatgaccctcatgctgatataaaatgaacacatattaaatatttaactcattaatgtaggaaccaataagatgttgtaagttcaaaggagaattcaaagaacagacttaattatagattaggaatattgaaaaaaatgtgaaaattgaaggaaaactggcctgggccatggtggaaaaaggaagccaattgaaatcctgtcagacagaatgttgcatttctataggaatattattttttgcattgctaatggctattgacaacttacagatttgtaaaatggctcaatgcaaggttggaatgagatttcctggaataatgtaccgtagacaatgcagttttccctgaataacacatttttcccctacagtacattgttccctctttattggataactagtatttaccattaagattttgctcaagcatgtaccataagaagccttccctggtaccttctgtctgtttttaggtttccctctacctctcaaaatagcttataaataacaatcactggtctctatacatggcattataattccatatttatgatttccctcagtccttcttctttaagaccagaactatacctttttattttatttttgcatagtatttgtatagtgttagacacctagacaaaattgacaagttgcctacagaatgaatgagtgaatgaatcaagtagtgatggatgtatgcttgtgtcaaatttacatgagcatgtgtgataggaaaacatttgtcatgcaggatgcatcagggatttgagcatggtccctttaactctgagcattgcacagctcatatcattactaaattaaactctatgcttacctgactttgctacaaccttactctctgatcccagaaaaattctgtataccttgaaactaatttatattagtgaaatacatattctttattcttgcaaaactgcctgtgaaaatgttttttaatcataggtcatttgacattatagtaatatatttgcaaaagtggaaagttttgcataagcacaagtaatgatctttaactaccttagaaatgatttaaagtaggtggtcaaagaatctttacttttctggtatttctggcattatggcaaaagcaacgaagcaagagctagttccttctctttacttccttcctgtaatctttgcaggttctttgtacatgttaggaaataaacctttattagttgaatctctaatctgttagtacattttttaaattacttagcattaagtctataatgagtagacagagaccatatacatgacccattatttaaaggttcttaaatttcagatatgtttacacaaaattgtgcttcttccgaatccttatttcagatgattcttgtttgaatatatgttggcacctgtatgttcaaaacagtggaggtgtcttggaaaccgcaagatgcatcctgcaaaaaggtagagggtggtagagagtgtcctgagttttaaataagtagatttttggatttgaatttgagctctgtcaatttctatatgcatgacctgaagcaagctacttaatttctttctatttcattttccttatatctaaaatgagaataataatcctgatttcatagagctgaggtgagggtaaggcagacaatgaatgcaactgacttatgaaagcaactggggaatgcattcattccccagccattccctggagtacaccttgttttatctgcatttgttcatccctgtttcttactccttgtcagtcaccaccttctttaaatccttcatggttgagcttaaaacccacccgttcctgccttgttgattggtttttcttgtcactgccaagtagactgtgggctcagtgagagcagaggctctgctctgacttgttgagagaccccagagcacctcctacggtctggcagcccacacccagtggactaaaatgcagccctggcaccatctttctatacttcttttctcagaggtgttgcctcattttgacctgtgttctctagaaacccaagaaattttctctaaagaacagacttaaagtgaatatagtttactccgtgctgttcatggttctgaatagagttggcgcatatatagtgggtttgattttctttaccaagctgccctgtagttcgagcagcttgcacatatgcttccagatagactcgcccagcatgccttccagaatccaatacagcttcagaattccagagagtgaggactgacctagggtcaaatgcattaacctgctccatcaccaaaatgctgctggaggattgaacagatgtgtgtcaatgcttgtggtatcagtaaaacatacgaaaacatggatttattttaactccctgtggtctgaagctgtaaggtagagatacaaaaattcatacactgtgattttttttgctgttattttcttcttcacagtgtatttattccttctgagcatctttggccatgcactgtgttttctttaatgaaagtagaaaatttgtatcctcattgcttatttttagcactgttgctatgataaactgtagcctaggcatcttattaaaatcaattgaggatttgaattattattccctttaatattgtggcattactattctttctgaaaatatttcaccatgtatgaatctatccaaatatttcctatgacttactggaaagatatttctcatctatttaagggatatataaaaaatagcctcataggggttggggacaaatgtttttgttttcctctggattgtttttgtgggaaagtgttaggtgcaattatttttttcaatactctgcttaagaataatttgtaatatctttaggatgaagttgcatagtacaaaacaactttttgtgaataaagtaattgacaattttggttttaattaccacatgtcatgactagtagacttcctaacaaaacacatagattgggcaacctgaatttttctacataaaaattgaggtcttacaatatcatgaggtcttacaatatcagtgaagcaataatctgcattccaagactttatgctgtttcacatgtgtaaatagcaactacagcatctactatttctgccatggagtctgggactgtttcaaggctgttcatctatgattttcattctcagtaccaggatcatgggcaggaatggagcttgaagagatctgggcccactcacaagggtttttaagaatcaggagatggtaattattaagaggaggtaagaactgagttgaacctaaagggtcgacttatattttaggctgttagaccagaattatacctccctttaaactagataaacatactagcataaaacaacctgcagtgatgaaggggaggccattaaacccaaagagtcctagttctaggccaagtgttaggctatctgctttcgtaagtacatcccatttaatcttcctaacaaccctgctaggcacaagttattatccccatttcacagatgaagaaaccaggctcggggagattaaataacttcctcgttgtaaggggttgcactggcatttaagcttagcccttatgattcaaagcttatgctttatgttatatgatgctaaaataaaggcatggtttttttcccatggaagaatatccttcatattttttaaagttgtagtaagtagcacataaatgagacctactcttaagaaattttataagtgtatagtacagcattaactataagcacagtgttatatagcagttctctagaacttttgtaacttgcatgactgaaactctatacccattgaatagaaactctccataggtctttacatctataactaaattctgatcacccattcctgtcccggcactgcttatttgtttgttggttttgttttgtatagagggggaaaggtgccacattaatgccgagttcaaggtcactgtttaacgaacaggtcttggggtagcaattgctataacatgtcaatagccagattcaccataaaggtgatcagactactaccacgctgttttattaatcactgtatgaatttgattataatttataatcaccaacatagtttctgttccatttaggtgacagactgttgatttactttgaattccaagatgacagtgcccctctgagtcaggcagggtatattttaagtcacagttacttgagaagtccctccccaaagcagatcacagacatcacttcttcatctggttgagaagcttctggatggagtcagactgcctggcagatcctggctgcactccagagaactatgagcactgccagacagccccctggcactagggctggccaaacagtcatggcacaaggatcctctgtacttttactgggcaccaagcccagctccatcagggcagaatgtggagctcagcagtttgaagtctggtctccatggcactagggccaaaggcaagctacagaaattccaaggcaactgcattgtctctggtgtaggcacatgacacattccacccaaaaaattaagagaggctgtatcctgtccctgatccaaggtaggaagaaaattctctccttttcccttctttgttcacattattcaaattgctttcaaacggtttgaaaaatcgatttttttctaataaactcatggtcttttaaacaggtctaacagcattggcaggatctcatatgaatgagcacagtactagaagacatcacgatgaggccttattccaacttcaggttgcagtgtgttttcaacatggcacttaaacttggtgaacctcagttttctcttattttaattacaatattcatggcatctgcctcacacgggctttccagggttgttttgagaactaaggggaaaactgtgtgttcaagaatttggcaaactggggacatagtgtgtgtatgccatgtttatgaatactcctaagtaagtcaacttcgtaagggttgggtctctgtggcatacagaaggtgctcatgaatgcctcaaaagtcgtggaaaggaatcttagtgtggggaggggggagagagagagagagagcaaaaaaagaagaaagaattcaaatctcggaaaacccaaatatgcttttgaaattagtaatctacacccagtaaaaatcttaaaatcttgcttttgttcattatgggatacccaagagatttaatctttcactaattgtttaaaaatcttttataaactgaaagcacacccaacattaagagttctgagcattctgaattacttacatttgtaaaattccttttgaaaaatgtaaaccaagcttatttcataatggtttcttcaaatcactttttcctattgtagtgtcctttactgtctatacacgggatcacatgttaatagtaccaactgtcctgagccctttccaaacaccaggctgtatctaaccctttatcataagatgtctcattgacttctcattgcaaccctaagatggtcatttttaccattttacccactttgcagttgaagctggttggagcagttacataactcaagaaaaggggcaatgctcataagtaagaagatgaggactcaatttcagactactagaagtcacaacccatgagttttgttttgttttttcttcaaagagccattcaagactccatttgccaagcctagacatggcttttatggagtgaatttgatctttattaatagctggaggcactgcataaaaggaacttctggccagagcctagtggtagttaatcccagtgacccagcctcattcattcatctgtttgcttctgggactaccacctgaacatttgttttgtcttggcttcttccctgcagcttgatacttcacatgtgtctctgttctgtctctcccagttcatcaaactggtttctgtcatcctcttttccatgtttgacttcttgagcactccacttgtcctccctgatcaacactagcctagtgaggaagagagaggccatgtattctattttcaggttgttttatgaagcagttaggccccactgagctcagaggagtgtgctaaggaagtctatggaaacaatgcacagttgtataattttgttttgaaatgtgttctgataatactttttcaggcatcaaagttgcctaatccctaaaaatatacaggtgtattatataaagaggataagatattatgcagcttaaactcctggaaaagttctcattagttatattttacaaccaagttccaatgcgaagcagcctgtttgtgagtgatgattagcgctgccaatgccccagcagtagcaggaaagaatgtcatgaaatgatccaacttccattagaaaataatgactgtcttggctgagcaacattttttaaattaaataccaacaattcctagtaatcagagagcctattagccatgaaattcgatttcagtatcagagactattcacttaccaaatgggagccaaataattgtgagtggaatttacagtgccgcattggggatagtagtaaatattatggaagtggcactagggtatagcttcagctctggggaaatgtggcattttaaaatttcagtagcaagttagtgtgatgattaacagaatgcagtcattaatttccaaggcatgatattttctctttagtcatttgagaacccaaggtcttacagtgaactcgtcattaattgctacttagcttcactgggcttttccaaatgtccatcagctcccttgagataaaatcaggaatctttgcattagaattagccttaatttatggagggaggtgttcttgatcccaggagtgatctttaggaagactggaaaataagtttatcatttctgccagctcaggtctaagtattctctcttcttttcacatggtctctcctgacgcatcactgcccaggtcacctcttcaatccttcctcattctttgcaatccctgttcagggatatgggaagaaagtattcactatctacttctgccatgaattgtgtcaagtaacccagacacaaatagtggaagtatattattaagcaggcccatgtagattaaatactgctccacagcacaaagttaataagggttaagaaggaggattcatacctaggtctatcctcagaacacttgttctttacattattgcactatggaaataaaagttgataaaattttaggtgaatacattgctctgccattttctaatttcgttttaatacattttgaaggaaacttaagcttggaaattaatgttttccacatgcagcactaaattccaccaccgtctttcaacagtacaaatccaatggaggaactttcagtatttttcaaacatatatatacatccatgcatatgtatacatgtatagtatacacaaatatacccatatgtatacacatgcacacacaaacacagacatatatacatatatatacacttatatacatatatgttatatatacaatatatatgtaatatgtaatctttcataatatctttcttttttatccatgaggactgaactttgcctaactgaaaaatctctctcttggcacccatatatgtgtctctacaaacttgttggcaaactgtatactggcacatgcattctacaagaccaccaggctcaaaagcagaacatttggcggatagaaactgcagtggcaggctttctaaagaataaggcaggagaagaaccccacagagatgcatggagaagataaaacaatttgtctgttgtcacaccctaggaagggtcaagccaggcattcaatccatacttagctggtcccaaagtccatattctgtccactacattaacctgctgctgtcagaaaaagaaaatgacagatttatagttctcctctccctgccccagtatatgtcagcatttttaggtatatttgaacaaaaactgaagttcatgcatgtcaattgttcttctaaaagccttcttagtggaaacatagggaaacatggcctttagacatgcccaaagtgaacacatttgttagaaaactcagtgttatgatgtatcatttagagttaacaggtaaaacattgcatatcagctgattttaggaaggaccaaatgccatgcatatttctgccatgagtgctttttacttgccatagtgggccataagtaattaaactatgtcattcgcatttgaaaataccatgactacaggccttacaaatagtctccttcctaagttctgtggctgttagaatctgggaattgacattgtttctttttttgtaaggagtccttatggctttcagatcccttactggaattcttgccacaagagggatactgagcagtgaaggtttacaagtctcccttgcgcttgtgcatatggattaacttcactcttttaataccttacttctccatcagttctagagcccactgtgagctgaggtgaaggcacattttccctcccaacaggaaagtgaccaatattatatttacttcctggggcaaatggctttctgtcagctttacttgtaaatctgcctcattctactggatctatctctaaacctaattgcttgcatactgcccaaagccacctttgggagctatttgtgaagactttgtctcatttgtaagctacaaagtctccaaaacacatattttccctcataatcagaggttgtttttgctttggtcaggaacaacattcctcaaaatatctgtagggggctaataagtcacaaagtgttcctgagtagaccaggaggtgtatgacaaagatctatgtctttctccctccttctatccttctctctcccttcacccttccttccttctttccttcttttcttcctttttgccatatgaaagaagaatggtctactgatctctctctctctctctctgtctatttcattaaatggcattgcattgcaatcttcccaacaaccaaagtcagagttgaagatcattcagtccaatctccttattttacagttaaaaaacaaaaacacaaaacacaaaactaccccagatgggcgaaatgacttgatcaagtcacatagtattgggcctagggcctgaacccagattctttgagtccaagtacagtttacttttaggtagttagagatataaagtggccactgagatacagtgcaatagaggatttccggctttttccccatccaaaataatctcagtcaaagacagtttgagggaatatactgattttgaacacgaaaccaaaattatagagaacagaatttttttaaaaaaatttgagtatatttaatttattgaaaaatttaaattggatattatttgtttttgttgcttttatttccaatggcgatggcatttggaactgaaatttaaaatgtaggattaggaagtagctttcacatttatctttattttttgcaaatacctatgcatatacatagattttcaactatgttttcataggatttaatggaaattgtcaaaaatgtctcaagatagttatgatttttaaatgttatgtttagaattactgatcaatttatgatcaaaactgcaaacagtaattgtaaatattttgaagttggtgctactgtatttttccccactatttgctactctgattcttaaatttaatggactcatgttgaagacaaagtatttacagttataaacacataatacatttagaattgtcaatggaagcttgactttttctcacaggatggttcattgtggttaagacttcattagcatcagtaatgtgtaggaaacttaacctctcattttcaaatgaaaagtgttcagaatttttcaactattaggctgtttgagttatctgtgctagacatttcttgtgatatttttgtcatttagtttttatctgtttttaatatcaagggaaagtgaatgctaggtcaacgtattttgaataaaattatagacaaaaccttttgagtaataattatgtagtaggatgcaaactgacacataatggcaacattcgcaaaacattttattagagattttttcctaagaggacatgaaattttggcattatttttattctgctatatttgtcattagatatgtagacagtttcatgcctgctcatttaaaatgtatgagaatctgtagcagtgtcactggtccctgggaaataaatgatgtcattaaaataacattaggactttgagcttcttaaacccagaattattatctttaagtgaggacagctgcatggcagaaaatgttgatgagtctcttagtgcttaattcaagtgttgtgtgatggttttcctgtacaaatctacactatattgatagtacctgagagggaagaaaacaaataagcaagttcaagcttatgaactactacatttctccacacttaagtgtgtcttatttcttacctcaatcaaatattagttggctcagaataaaacttttttttaaaaaaagctaaaattatctctttgctttgcttgttcttgtggtactactgtttcaaaaagtcattatttagtgataaatatatttgtgttcagggctgttattttaagttagaagagtagaatatgtagttctttttatcaaataatcccagtccttaacttcttaattttgatcaatttctgtttgggtagtgaatatatttggagtatttttgcacactggagaatcatcctgtcacctccacacatggaataacataggtaggtataacactctggtccatttctgggcagttgctttgctttatattatatatttttgatgatctaatgcttgtaatacagtaagtcctcacttaacatagttaataggatcttggaaactgcaactttaagtcataccacaaaattggttttgacatataacaaaaccagttttaccataagctaattgatataaacaacagttaagttcctgctgcatatttctggtgtacaaaacatcaccaaacttctaaataaataccaaagctcttctaatattaaacattgaagtaaagtgttatctgtatatacatttaagatagactaataaaaacaagtaaggtaattgtttatttcatttttggtgaatgagtgagcgacagtgattgtttgtattggtggtgagtttaatccaggaatgaaggtttgcaaagtgaaaattgtcagggacgcttcctaccaccacacagttaacaattacaaatatggtgagctaaccgagagcttctgtaccacataagtttattgttgagcatgtgtatgattatcatatactttatgaagttttgctttacaataatttgtatttattaattcactttccaactctctcactgtagttcagggttgcaggtggccagatcctatttcaggagctcatggggcaaggcagcacctaaccgtggacaggatacccttccatcatagggcacactcacccacatacccacactcactcaggctggaacaatgtagacatgccaacaaaactaacatgcacatctaagggatgtgagagaaaacaagaatatccagagaaaaaccatgcagacatggagagaacatgccaacaccacatagacagcgaccccagctggaaatcagtgtttttcccccattaacatcataacgaaataattttttttaatttttattttattattattatactttaagttttagggtacatgtgcacaatgtgcaggttagttacatatgtatacatgtgccatgctggtgtgctgcacctattaactcttcatttagcattaggtatatctcctaatgctatccctccctgctctccccaccccacagagtgtgatgttccccttcctgtgtccatgtgttctcattgttcaactcccacctatgagtgagaacatgaagtgtttggttttttgtccttgcgatagtttactgagaatgatgatttccaatttcatccatgtccctacaaaggatatgaactcatcattttttatggctgcataatattccatggtgtacatgtgccacattttcttaatcaagtctatcattgttggacatttgggttggttccaagtctttgctattgtgaatagtgcctcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatatcactgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtagattctggatattagccctttgtcagatgagtaggttgtgagaattttctcccattttgtaggttgcctgttcactctgttggtagtttcttttgctgtgcagaagctctttagtttaattagatcccatttgtcaattatggcttttgttgccattgcttttggtgttttagacatgaagtccttgcccatgcctatgtcctgaatggtaatgcctaggttttcttctagggtttttatggttttaggtctaatgtttaagtctttattccatcttgaattaatttttgtataaggtgtaaagaagagatccagtttcagctttctacatatggctagccagttttcccagcaccatttattaaatagggaatcctttccccatttcttgtttttgtcaggtttgtcaaagatcagatggttgtagatatgcggtgttatttctaagggctctgttctgttccattgatttatatctctgttttggtaccagtaccatgctgttttggttactgtagtcttgtagtatagtttgaagtcaggtagcgtgatgcctccaggtttgttcttttggcttaggattgacttggcaatgtgggctcttttttggttccatatgaactttaaagtagttttttccaattctgtgaagaaagtcattggtagctttatggggatggcattgaatctataaattaccttgggcagcatggccattttcatgatattgattcttcttacccatgagcatggaatgttcttccatttctttgtatcctcttttatttccttgagcagtggtttgtagttctccttgaagaggtccttcatgtcccttgtaaattggattcctaggtattatattctctttgaagcaattgtgaatgggagttcactcatgatttggctctctatttgtctgttattggtgtgtaagaatgcttgtgatttttgtacattgattttgtatcctgagactttgctgaagttgcttatcagcttaaggagattttgggctgagacgatggggttttctatatatacaatcatgtcatctgcaaacagggacaatttgacgtcctcttttcctaattgaataccctttatttccttcttctgcctaatttccctggccagaacttccaacactatgttgaataggagtggtgagggagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtctttggttctgtttatatgctggattacatttatcgatttgtgtatattgaaccagccttgcatcccagggatgaagcccacttgatcatagtggataagctttttgatgtgctgctggattcggtttgtcagtattttactgaggatttttgcatcaatgttcatcaaggatattggtctaaaattctctttcttggttgtgtctctgccaggctttggtatcaggatgatgctggcctcataaaatgagttagggaggattccctctttttctattgattggaatagtttcagaaggaatgttaccagttcctccttgtacctctggtagaattcggctgtgaatccatctggtcctggactccttttggttggtaagctattgattattgccacaatttcagagaacgccacaaagatactcctcgagaagagcaactccaagacacatgattgtcagattcaccaaagttgaaatgaaggagaaaatgttaagggcagccagagagaaaggtcgggttacccacaaagggaagcccatcagactaacagcggatctctaggcagaacctctacaagccagaagagagtgggggacaatattcaacattcttaaaggaaagaattttcaacccagaatttcatatccagccaaactaagcttcataagcgaaggagaaataaaatactttacagacaagcaaatgttgagagattttgtcaccaccaggcctgccctaaaagagctcctgaaggaagcactaatcatggaaaggaacaaccagtaccagctgccgcaaaatcatgccaaaatgtaaagaccatcgagactaggaagaaactgcatcaactaatgagcaaaacaaccagctaacatcataatgacaggttcaaattcacacataacaatattaactttaaatgtaaatggactaaatgctccaattaaaagacacagactggcaaattggatagagtcaatacccatcagtgtgctatattcaggaaacccatctcacatgcagagacgcacataggctcaaaataaaaggatggaggaagatctaccaagcaaatggaaaacaaaaaaaggcaggggttgcaatcctcatctctgataaaacagagtttaaaccaacaaagatcaaaagagacaaagaaggccattacataatggtaaagggatcaattaaacaagaagagctaactatcctgaatatatatgcacccaatacaggagcacccagtttcataaagcaagtcctgagtgacctacaaagagacttagactcccacacaataataatgggagactttaacaccccactgtcaacattagacagatcaacgagacagaaagttaacaaggatacccaggaattgagctcagctctgcaccaagaggacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactgtctctcagaccacagtgcaatcaaactagaactcaggattaagagactcactcaaaaccgcacaactacgtggaaactgaacaacctgctcctgaatgactactgggtacataacgaaatgaaggcagaaataaagatgttctttgaaaccaacgagaacgaagacacaacataccagaatctctgggacacattcaaagcagtgtgtagagggaaatttatagcactaaatgcccacaagagaaagcaggaaagatccaaaactgacaccctaacatcacaattaaaataattagaaaagcaagagcgaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccagcgatcccacagaaatacaaactaccaacagagaatactacaaacaactacacaaataaactagaaaatctagaagaaatggataaattcctcgacacatacaccctcccaggactaaaccaggaagaagttgaatctctgaatagaccactataacaaaataatgttattcaaagttcatctgacatgctttttcatttattcttcgtacggtataggaagaataagtatatgctttttatgatatacttaggtcttttctcaggttaggaaactcttcttcaagtaaggctttgataattgtttcactgcaaagattgctgccttattttttagatttggatgtctgttgtctgcattcaacatcaatcataagaggacccttcatcattttcaccttgtgtgttttagatagctcaagtagtttctatataacactcctcatatattgctttggatacattctgtttcttaatgtttccaatgggtgttattttttctgctgttgcagttagagcttccttaaatcctacttctttacatttaaaaaacaattataagggggctgccaagtaactttccaaaattttctcttagctcctattgaaagctattttcaaagataactgttccccaagactttatgttgtttctgctttttcttttctttccagagtttttggatttttatgtgagatttttgtgtacatttagattgcagtgagaaaagcccattccaaaccccatgtttttcaaaagagagggtctatggagaacccttgggcactctctgcatccaattggatgctggtcaaatttctgtctcatatcaatagctgcaatagatggatatgagtagcccagagctcagtttaaaagcaccaagctgacattcatctcgtgtgaccctgctggtttgagatgaacccataaaatccataaaattaaaaatctcaataatcatagcccctaggaatctaagaattgtttatttcctgttgtgcctatagtgttgaatttgcaggaatgacttattgtagaacagaatatgtttcattttctgtaccatcccctattatccaccccacacactcaccagcaacatatggtcttcctttccagtgttttctctgaaacttcagttctgaacagatatgctaagatggataagcagtgatggggctgaaggagagcgatgctttaactgcactttgtgttcaaggagtggaatattcagacatgttagactgagtattaaatgttcaccaagtcacttcaacctcatccttcatttttaattttcttcatacattactgtcagaaattattctgtttaattatagattggtgcaaaagtaattgaggtttttgccatcaccttcaatggcaaaacctgcaattacttttgcacccaagtaatattttattataaaccacagcacatagtgcattctcaacaaatgttgctgttgggatgcaggaatggatggatgaatagatgaatgggtggctggctggctgaatggattggtggatggatgggtagttgttcaggattctcattggtatgggatttgtgctgttagtctgtgtgtcctgcagactaacggcacaaagaaagatagaaggtcttgctacctgctctcagactggtataactcacattatttggcaatacagagactctcagtcttagtttttattgggagtgtaaattttgcctctttgctatgccttcgtagacattttggtggaaagtggtgacagacagtgtcacaggctgccaaccaggtaccactttaaccaccaagactctgataatgtctcgtttcctcctcccatctctaccccttgcttcctctcagactcctcctactctctgtctctccagccatgcctccacttgcagaatatccttctctctacccaccgttcatctttaccctggtcatttctttagccacgtcctcatgcgtatccagcatttctatcctgctgtgtcaaatataagacacattctttaactttagagggaatttatattttctcgtctgtagttttctggaaatagtggggaggttgtaggctgtgatcaatttgggagccatttaatggcagtaaaatgggcaaagcaatatatcgagaattcttcaaattgatatttatctattttcatccagccttaggtattttaatacagatacaacttttactaccagcaaactatagttagtaattgattttttgcttcctatttcaaaagctacagataaaaggacattaatttttaagaggccactcaatcagaaaatgcattcttcacttagagtggtcaaaagagcagtggagtggaactcaggaaaccagaggactagctctgactctgccacttacattgtttgaagcaaggtatttctgttagggacctccatgggccttcactctaaccaacttttctgtcaccttcatgtactaagagtctctgatcccgtgaggatgacgtctacttgcccatcactgctcctacctgaaacccaaatgtgccgaagtttggatcccagcacaggctcagcatcatcatggatgatcagctcatagtcctagaactggctgtggagacttttctgaatatgaacattgtttttaaatcagtgttagtaaacatggactcaatatttacttgaaaagaattatttcagttacagattgatgtagttcattttaaccaccttgtgtatgaaggatgaaaaatgagtgatctagttttgaagtaactacaaaaattgtgtttgtatcaactgtcctgtttatttttgcttgtcataatgagaggacatcattattaaatctaaattatctccaccacagtgtcactaaatatgatcagtcaactatctctgcttcctttacttgagatctgttgaactaaggtcaaactgagctcaagcttctcatccagattatggcaatacacacctttccccaccaattgttctttaaagcattgtgagttggcttagcaatgtcttcttccatctaaaggtgggtcacagcactggcaaatgtataatgttggactattgctgggagccacataccgcattagatttttttttttttttggtacgctaacagctcctcattttctggcaatgtatgacaggcagaactgtaatagttatcctcataagcaatgtgcaagttagataattgcaatactaaacacaatgaatattcagtttgtttaggggcactgcagtgaaaaaaagaaatgcatgtagttgtgatctacctgtctcaccaaaactcacatttagtctttcctaaaaatacctgaacttcattaacatcaacttcaccagtactctttcagatgactgcatattgaattaggctgaagggaaggggaacagtagcccatggggtcatatcagacttgtaattctgctctttccaaaagacttacagtgacagccaaccacattccaagaactgcactggtcaccagagatgcaggaggaatgggccatcatttctgtgcccaaggagctcacacagactgtaattacctctgggaatctcaaagaccaaagcaatgtgaaattttgtccacattgttctcaatagtgactgagctattctatatttgttccctgatctgttttaagaatgaaaatatagagaaattagagttcaggtgagaagagttaaagtgattaagaggatggtgaactcttctaacaagaaactaatagcgtgtagcttagttcaacagtggtaagtggagctcatgataatgatatataaatgtttgaaaaatataaacaagaaggggcaacattgtttagtattattcaattacaagtgattaatagcaatgcaaagtaattatgaaagggaaattaaaaatggacataaggaaaaaaagttttcttttggtcttgtttcctaaaagaaaatatagggctacattataggaaagcatttgcaactacacaagaaaatatgaaacaagcaagctaagagcaagtaatttaccaatggtagactaattattttattaattcattattaataaaatttattaattcatttatcaaatgtttttattcattcatttatcaaattaattattcatcaaatgttttaggttactcacctatttaacattttctttgctcccatgtattcatgtatttcatttgattatttttttttttaacatttcagtgttccaaaaattgggagacataggcagtaatatattttttaggaaaatactggtggttgtaataaataatctgatatttcagtagtccaacacattaaaagtttggttctcattcatataaagtccaaatcaagtgtttattaaaggcagaaggatgagggttggattgtgggagtcgatggttggaggggcccagatccatgtaatcattcagagatccgggctgaggaagatccataaattcactgtgatctccacagccagctggaagataagagcagaaagagactgaggaagaagtaactcctccttacacactcggttccagaagacactcagatcagtttcacctatattccattgttgagaattcatggaatgacattgcttggatgcactgggcattgggaaatgtggcttctttcctagcatcatctctacaactttcaggagagcatgagtttttaatggacaaacaggtgaataaaacacactcaaattcctggcctcttggaaaatacattttagttggaggaaactgatagtaatactataaaatcataagtgaaataaacattttttttgtaaggacataaacattgtgatggtatgtaaagcctggaagaagtgcagggagtgttgggtgtgcaattttaaatggatagtttggaaggagctcagtggaaaagaggtatttgagcaattatttgaatgaggtgagaatgtaaatcatgtggaatgtaacgggaaattatttaaagctgcagcgcagcaaatggaaagctcatggggtggaatcatgtctgatatctttagggaacagctggtggctaacctattaggagcaaagtaagcaaaggttagagaatggtaggatatgaggtcggagaagtaatagggttctaaacatacagaggccttaagagtgacagtgagaattttggctcttactctgaggtacaggggaagtcattagagggtattgtacagaggagtgaagtgatttgatttatgttttaaaaggattactctagttgttgttctgaaaatagactgtggtgcagtaaggcagaaggagggagaccattagaaagctttttcaataattgaggtgagaaatgatgacagcttagaccagagatattgagaagtggctggattctgggtatattttgaaggtggaagtgacaggatttgctcatggcttagtggtaaggtgtgatggaggaaaggagtcaaggatgactcgaagactttgtgcataaaagactaagtggaagagtaggatttttattaattgagatggggaggactgtacaggattctcatttagatgtgggtggagcacataagggtcttgatttggaatgacttttagatatttaagttgagctgacaagtaggcagttagatatatgaatatggtattggcatggggaatggaggaatagatccaaatattgagctccaagggactccaatatttagaggctggagaagtggggaggaaccagcaaaggggaatgaaaacgagtgacaagagaaagaaaatcagaaaagtctagtattgagaaagccaaggaagagaagtgtttgaattaagaaagaatgaggctgagccaggaggatctcttgagcccacgagttagagaccagcctaggaaatacagtgacaccccagatctataaaaaaaaatagccaggtgtggtggtgtgtgcctgtagtcccagctactaaggaggctgaggcaggaggattgcttgaacatgtgaaatataacgggaagttcaaggttacagtgagctagatcataccagcacactctagcctgggtgacagcacaagactctgtctctcttaaaacaaatcaaagaaagaaagaaaggaaagaagggaaaagaagaaagaaaagaaaggaaaagaacagaaaagaaaagcaaaaaggaaggaaaaaagagccacagtctcagctgctgctgacaggtcaaataaaatgaaatagagaggtcattggtgatcttgatgaaaaaagaaaaaagaagccgagcgcggtggctcactcctgtaatcccagcactttgggaggccgaggcgagcagatcgaggtcaggagatcgagacaatcctggctaacacagtgaaaacccatctctactaaaaatacaaaaaaaatagccaggcatggtgacaggcgcctgtaatctcagctactcgggaggctgaggcaggagaatggcctgaacccagaaggcagagtttgcagtgaaccaagattgcaccactgccctccagcctgggcgacagagtgagactccgtctcaaaaaaaaaaaaaaaagaacaacaacaaaaaacagttttagtgtagtgatgagcaaaaactgactggagtgaggtaaagagaaaatggaaaaaggcaaattggtggtaattatttaatttttttatctaattgttttgaggattttttctataaaaggagcaaagagcaaagtgatagggtgataattagaataggaagtagacacaaggaagggatttcaaaatgggaaaaatgacagcacatttgtaaagcgatgaaaaatttacaatgcaagaaagagaaggggagttaatatgcaacaatcttatgtcgatgagaagggctggaacaggcactctagtgaagggactggagataaaggcaggtttatctgtaatggttcagattaaggagtgaaatgcatggtaggcttgtgtgagttccctttgaatttctccttttgttcttaggaaataagaagcacaggtcattcagaggagaagatgtgaaatcattctttaagggaataggatagtgaatggaaaacggaaatcttcccaggcagtttcgaagaccacttgaggctaatggtcatgtgtggaaagcaaaatcattcaaccttgtgccttttaaaaaattttgtcccatcatagtacctgtgtgggagtgtgactatagcataatggagaattttgtttagcgagttagacattttttcttggtcagtacaatggcatgagagatggttaaggagtttaatacttgagcaagagaattattaaaacagcatgctggagattctaagcttggtcaggtgggtgtgatgactttaaagagttgaatatggtagtaaaatggtgaaaggattagtgtatttgaaaaaaaaaattagtgttatgctactgaaaggaatgccataggctcactctgataggaatctttgaagctaaaaggatggagtggttagttgttggtaatgagaagatttagatacaattatagaagtgaggggctaaagatgattgcagaataaagccacaggaaatcaaagaatggagaggctgaagtattggaaggatcgtcaaacttgtttaaatctgagaattttgacaggaacagtgtagatgtgacacagagccaggaactacagtcttacagctatgacattccatctgggatttttcaagtatctcattgaaattttcttttttaacagtctagttggggttagctctgagtttttgtttaaatagaaatgtttttattttgactgtagctttcaaagatgcttttctggctagaattccaggttaacaattatgttctcttagcattttcgaaatattgttccattgctttctgacttttgtgtttgctattgagaagccagtagtctaattattgtttattgtggatgactttttttcccacagctgttttttaaaacttctatttatttttacactgcaatttcagtaggatttatctacgtgtagaattcacaaccttctgattctgatcattgttatctctcattaattctggaaaattcccatgaatttttactccaaataatcattgtctttattttctattaggattttgcactttatactgcttgttggatctttccactctattatcctttccttaaaatatttctttcctattttccatcaccccttatatgtgtacttcatttcttgtattttcttcagatattttttcaatgtactaattttcctttaagccatatctgatagtctttttaacgttacatttttcatttctatagagttatttggttctttatcaaatacgtatgtataattttgttagttcttttttcctaactcctactccaatttctgttatttatttaaacatgttacacatgcatgatttatagtctctgtgtcataagtccaatatctgttgttctttggtgtttaattctgtggtatgttggttctgcctacacgtatacatggcagcttatttcctcatttgtataataattttttaaattcttttgatctttgatcctttgaaattgttggggtaatttttaggctacatttaaattgtcttcagaaaggatttctaggctactttcagataactagaggccttagcaatctataactactttaaattatactttaagtttgggtggggagtggacaagggtatgataaattttgtttcaaacatgagggcaaatttttgtttaagaattatcaagagagttctccttctccttcactgcctcctcttcgtccttcttcgtatctactttaggccaaagctaggaccttcattctaaatgagttaccatgtatcagggattcaagatactcacagggagtcttcaatctggccttctaccttagttccttatttgcatggccgactaaaactcagactccgggccaccagtgattggcatataaactgaagaaaacttcccattctagtgcttgcttactcatgtggattctctctttctttcctttcttttttttttttttctttgtaaagccttctaaagaattcccttactctcctgtgactacagtcgtgcattaaaaaccgattatttgatatgttatattattaattgtgctaaatgggaaataaggggtgtcatgttctggtaacatttactcaaacttttatatatacaagtctcattgggtgcttcatctttgtgttttctcttttttccagggctctatgtatattaaggatagcaattctaggccatacatagcaagttatttttttccctagtttgttatatctagttttaactttgataaaagtgctgtgtttttcttcttaagaccttttaagtttttatatagtcaaatatattgatctttccttttaagttctctgcatttgattccatgcttagaaaattgtctccgtcgataccataaaattattttttaatctgatatttcttctagttcttcctagaattaatattttcaacgacccgtttcatctgtagaatataaatgactccttttatgtggtgcagaatgcttttatgtataggtatgccttcaactttctattatattctatctatataatatatatttataaatatactttttctagaaaaaattagcttaatttaggtcatattgagtagttccatcacaagtttttttattttgatttttttcccttctccttcctttagtcatctcacaagtttttggtgttttttcctaaggaaacatggaaggtcattctactttgcctcaggccttgagaacaaaaatgaaaaagttggacacatcaaaaccctaaatctaggcactacagacaactgaagaggcagttcttatttagggtgatatattctttaatagaagatactctgcttgccatgggaacgtatataggaggtgcgtctgacctggacaatacaatcaggaaaagcttcctggcaggggtgatttgaagtctgtatttccagtatgtggggaatggtggagaaggagcaagaaagtcatgccgaggcaacatgtgggacgtttccagtgagacaaagcagaattatttgaaaaactaaaacagtagttcagttggggagaggtatacattgtgatgtgcaaatgctgcagaatgaagccggacaggaacaagggccaagcaatgaattgtggatgttttattgagagcaatgagatgcattgaaaggtttgaaactgtggaataatgtgatcaaatctgtattttttgaacaacatctaggctgtagcactttttatactggatagaaaatgacaaaacccttagagggatgggctgatttagaggatattgctgtaatgtaggtggaaagtaactatggcctagtaaatgtggaaggacacagatacactcagtagatatttcagggtgaatggccagattaggtaatgactaagatagcaaggatgggagaaaaagaagaatcaaggaggtgactaagcttttttcttgagcaactggtagattgagttaacattttctgaaaaacgtgatagaaggaggagctgtttctaggagggaaataaataatttggcaggagactttttgaactagatatctattgaataacaaagtgacaatgttccccatcctctcatttccattcccaattttacttctcgtcccaattcaaatcattcttacttatgatcggcgctatgtcagtgcctctcagctggtcttcccagacccagtacacctaatcaatccatcctacaccaggatggattcttcgctttccatacttgtggctttgtttattctgtcccctcccctgggagacccttctgcctacatatcttaaagcctatctacaaggacaccttcatgtcctaggtaccaccagtggcttctgatatgttcccttgatgatcagccataacattgtatttgaatatgttgtaacttagtatagaaatcatgggtactggacacaggcaaaaccacctctgccacttgcacggccctggaccccaaggaaatcaactgctctaaacttctgtttcctcctttaaaaatgggtgtaataataaagaccttgtttgttgtgaaggatacaattaagattggcacaatatctgactcccccacacaggaatttcatttcataaatggtaattattactcatattgtctacaaagccatttctcacagtctgttgctatagtagtcacttacgtgtctgtatctccttatatgaaggcatgagcatttcctttattgtcttcacaacaattaataaggacaagcacaatgtaggtacacaatatatggcatgcatgaatgtttaaataatgagagttactaggaggatagagaattacagaaaaaagacttgcttaaactgaaatatttcttactgtgtgccataaagtgctgaggggtgctgtcttctaccatgaatccttccagcctgaactgcaatgattttaaattttttgacagttctgttctccctaagagtagtaattttggtggttatgcatagatcaaagatgcaatagggaacgttttaagtgatgttgtaaataatgatttcaagaatgtgctttaatttttattgaatatcatctgattagcaatcttgtttttgttttagccttgtgaatatttattctagcataaatgagtacagtaatttctaatgcaaatattgtccacctgggtttcctgatgtctgtatggataattcaccttgttctttgttagtggaattattggtgcctctcaggttggaagatgcctgtactgacctacctgtggccagtagaaggtgggaagacctgcatattgcctctactcaacctctttctcccagtaactaagaagcctggactgggctggttggtgcggttcgctctttctgactctggttgtctcattcatgccagttcgggtgacacttgtgagaggaaggagttcagtctttgaggtcaggcctgtctggctcccaggcccaccactgccacttcctatgtttgcaatctggaaatagctccatatgttttttgaacccaagttgtattgttttggtttggtttcagtgtatgtaggtatgtgataatctttggtggcttacgtctgtaatgccagcactttgggaggcagaggcgggtggatcacgaggtcaggagttcaagaccagcctagccaatatggtgaaaccctgtctctactaaaagtacaaaaattagccgggcgtggtggcgggtgcctgtaatcccaactacttgggaggctgaggcagaagaatcccttcagctcaggaggcggaggttgcggtgagccaagactgcgccactgctctccagcctgggcaacagagcaagattttccctctcaaacaaaacaaaacaaaacagaaaaacaataattttaaaacaggtagggtgacccccatttactccttggagatctagttgaatttatattgttcttccaattctcaggtctgcagaatttaaaactctccccaaggtttttacagagtttccaccttggatgttctcctggtcccctctacctccagctcccgtgctgtggtcattgctgcccttcaacccatatccgtcataataagaaacttgggctttctaccagtttccttttaaaaatccacttgcatgtgtttgtagagtgagctcagtgaatgctggggtatcatgatggagtcacactgcctttaggtctttacttggatttctgttttccccctcttctcccatttctggattaagccttctctccataactgctctcttccctccttcaccttttttctgtctgtctccctcctttccttctgttctcttctttctgtcagtgtccctttctctctctctctctctctcacacacacaaacacacacacacacacacatacatctcttaaaaggatagtgatactttaccagttgatttacaaaaatttaaaagcaattatatatagaaattagtcagtgagctgcatggtgcaaatctatattggtctttccttttctttgcttttgatgaccaaagaatagctatccaaagatagctttgggttgcagctgctgccaggtatcatgcagtctggacattgggcacaatgtgtcagcagaactgggggtgatccaagcagcccgggaaacaaagccctgcttgtatctctagagtgttctttcccctgaagaggcccaaggtccctgagagctcagcatagctcatttctttattatctgccacagtcttcagtctcctctggatgccagaggggagcagattggatttctgggagagtcaacaaatagaagttctaagaattaaggcaggccgggcatggtggctcacacctgtaatcccagcagtttgggaggccaaggcaggtggatcacctgaggttaggagtttgagagcagcctggccaacatggtgaaaccccatctctactaaaaatacaaaaattagctgtgcatggtggtgtgcgcctgtagtcccagctactcaggaggctgaggcaggagaattgctctaacctggaaggcagaggttgcagtgagccaaggtcacgctactgcagtccagcctaggggcagagcaagactccatctcaaaaaaaaaagaaaaagaaaaaaaataagaattaagggaaagctggctcccaggcaatgggatggagcagaatataggggcatgagatggagaggctatgctgtctttctcccttttgatgatgctactggggaaaagtatcatcatcaaaatgtggaagggaaaccaaaaatgaagggaaggtactgaagagaaacaaaaatgtgctgaatccactcttaggaaaatgactggtctttttccttgctgtgtattcagagcatacctactgctagagctactgaatctgtgcttctggagtggtttggccatttgcagctccctcatttgaggactaatattgccattctgctgttctaagcagccattatctgccgcccaccccaccaacttgataccccattagtgttagggtacataacagtacctcagccaaggacttgagtacctccaggcaagtcactcactcaacattgtggtgtcttcttcagtgatagaatggaatacctgggcaatcccaggagtcccctccacctcaaacaattcagttcttctgtggttctacacttatgattcttttgatgagagtattcatggctgttttctcatttttatgtcactaactatcactggaaatgcattttaggtttatcatcattttacagtctcaagtttctgtttttttttctttattttataccaagacgcaaatgtgaaaaaaaaaaggaaatagaagtattacaaatatcttagcttataatagcagaccaaaagtaattggaagaaacatgagatgagaaagtataaacatatttttaacataactctgctgttctactgataaacaatttctgctgctctatttgtatagagacaatcaatatattttttagaggcaggaaaagatctttttttttttgtcagatgaaatgttgctttctaaggatagtcaatcggtgcccttaataaacccatcagcccttgtgtcttggtatagcattattggtagaggtaattatagaagctaatatttggtaactaaagaaagaaaactaaagaaactaaagaaagaaactaagctaaagaaaggaactaaagaactaaagaaaggaactaaatagctgaagaaagaactaaagaactaaagaaagaaagtaaactgggaactaaagaaagaaaaatgatgtattcaaagggagagcaagtccctcccaccatcgtttgatctatcaggtgtgatttgcctgctggcttacatcatggaaattttacttccattttttaacaacatagctgggagaacaaagaatctcaaaaacgttttagttgtagagagggtttactgccctgatgaatgactgatctgtatttctgaaaggaatcttctgcctcttatcatgatccagtcttgtattttttctcatggtgacagtgatgttgtacctcatgtcaacatgaaacataatttttcccaaacaaacttttaaagatagggaaacaacattgacatgttctggtttggaattgtatcagtgaattaaggaatggatttaaggaaagatcattagaccaagagtcaaaataactctgtggtccaatcctgcatagcttatagtcctgagatcacaggaaattcacctaagacaggatcattctagtaccatggagatttgcctggtccacctcacagggctctcatggagatccatttaagtgaaatatactaactaaaggtaatcattttcttatgaaatatcaaatatatataaaaataatatatttattataaaacaataaaaatcccattcactaatcattattgaatacacattttaaataatcatttgctgaacaaatataaagaaagcatgaagcctaggagatggtggaaaaatgacttatacgcgttgaaaaaaaaagcatcaagatgtcaatagatttgagtagctaactaaattagatataatctttgatggataaatgtaaagctatagacggacgatcaaggagtaatgcatgaagatgagatggcctgatgcacacttatgagcatttaagtacaagagaaatctgagccaagagaatgccccaaaagttcctgaagttctggtaagtgctgatggaaggggtgacccacagcctccacctggagtttagacatcccctttagctgaacattgtcctctcctgaaagtttgctgaatagtgaatttggagatagcaagaacctttatctctgtatttttaatggaagaagaattattcaaaactccaaccaaagtcctcagtatgttgaagatactcttaaatacccatataacaactattcatgcacacataaagaatttcatacatccattgccctgttatttaacacttaaacttgttctttgaaatatttgtgtgcagaagctgagcagtatcagagacaaattaaattttcatttcataacaaacatctatctcaatatactttatcattccaacttttcttctaaaataatggattttcaaggcctttaaaactcactgactttcttcaaaggctttttgacttccgtaggagacatatttacgtaaaactatgaggggaattgagagtgataatgaaaaatccatctattaatagcaagcacaagcaggagatgcttgttattagaataaaaacacatagacaattgcagaacactctgcttcctctcaccaggtctggcctgcaattagacattttcactgatgtgtataaatagagtggggtttagagtttgataataacttttaggtaaaatttattgtatatcattgtagcaaacattcgtagaatgagagtacatatagtgaaagatatatacattgtgtcagtttgtgtcactgggaaggattcactatctgccttcttaatgtgacacagtaattcaattaattgtgtaggactccagtccctggcacatagtacatgttaaaaaaaaatttgctgaattactgacagaagggggaagaatatagactactgcattggggttatcagtagagagtacataaagaaaaatgtttttaataattaaaaattctagttagaaaataaaaaaggagatagtgtgttctgtgtctctagatggacccttgcaggaggaggaatattttaggaatttcgctgaacagattcatccctagttggatttttagatgcaataaccagaaaagatcctcccaccaatccaaagtctctgattatctgttcaagaatttgtatatcccaactctttgtgtagttaaaaattataaatcaaattgctctttaatctagtttttatgtcaggaacaaaactcacatttcaatttagaaattttgcaaaggcctgttttccattgctatcatcatttttattattgtcttaacctttacttttaaaaatctatcattttaacattataatcattagaagaaatgaacgtgaactaaaatgtatgtattttgtttcatttttaatttaaccatgtcttttacaagttaatgaggatattaatttttcaaatataatttttagtttctttattttgcctaaaatctaaaaataactaccatataaaacaaatattatcttgttcactcatcttgggaatattcttagtacaagaatgtgtttatgatttaattgatgaagaatgtaaatatacatctacacatattcatatgtattaattttcatgtattatatatgcataaattaccttttcaatgtacatatgtgcatatattttgtgtaaatgtacactctgtctatcagtaaatttgtagacatgcctatgggatttgcaatctagttaagttatttcttactgttacgtacttttctgttttacttatggttaactgatgcagggaaggcagaggcaagggaccctcattttggtatcctatttgggggcctctgcaatatgtgctttctggagcctggaccatgcatactaagctttgtggactatcagaggtcctacaagcacacaatatttaaaattctataagatccatgtctgctgagtacttacctgagtgattcacttcacgaagacctgaaggaagtcaatgcaacatttatgtttccattctctctacaccagtgagtataatgttcttaggaccagtaaacattgggatcagccatatgttgggaagacaccagctagttcaccacccatggtacttagacctattcttttttttttgagtcatgattaatgaatcctatcatactggctgtcagaattctttggattcaatttgtagatacccttgtccatagactcattaagacaattttcatattagtgtgaatcaacatatataagtaacttgagtaactcctcccaagaatgcccttctacttttagctattagatcctaaatatacaaaagttaagaggctttatagaatacaactgcaaattttatttcttactatattctgttgaatttttctcagtttgattttttttaaaaaatggcaaatataacaaaccccaaaacagtggagcacttctatttcattgtcaaacccaattgacaaaaatttgaagttagtggaatttttttgaaggaaaatttatccttgaagtcatcaactattgtaattcatgctttagaaaaacaagcattaggactgaattgtattttcttttaaattcatttatgttaattattgtaaagaaattttcccactctacttttgttccccatttgctgtttgttgttgtcgtggtttgtttgcttgctttggagacagagccttgctctatcccccaggcgcaatcttgcccactgcaaccttctctccccggttcaagccattctcctgcctcagcctcccaagtagctgagattacaggttcctgccaccatgtctggctaatttttatatttttagtagagacgggttttcgccatgttggccaggctggtctcaaactgctgacctcaggtgatccgcctgccttggcctcccaaagtgttgggattataggtgtgagccaccacacctggcctgtctgtttgcactcctgctgacagcaccagtggattgctattgtgtttttcagagaggaaccaccaaatcagaactgttagacctcaaacagttgtttttgacacagagtggtggaagggagccactcaagaaaccttgctttattatcttaatgctctcaaagcaatctttgtcatttcctttgaatagcactttgcgagtttcacttgacatatggcatggccctcagggatataggcatttgcttttcagtctaaacaaaaatcaagtttataatttttatttttgtaacaatttatgtcagtattcatcacagaaaagcatattcctctttttccttctgacttacattcctcctcaagctacctgtaagtaatgatcttgaacagtacacaactgacaagtgtttcctgcgtcgaagaatggttgagtgtgtgagtgtagaacaatagaattatagtttataaatactgggatttcaggactaatgtaataaggagaaaccatccttcctttttatagctttgagggaattgcaggaacaactactgcagcttacagtagaacataactgtttagaatgccttttaacaattagtatttagtgtctcactttatttctaaggccactgcacgtgatacagaagcctgatgacagtagcatccacattcttttaaaaatgtgtaaaataaggttataaatgtttacttttacaaaaattcattgattccctcctttattcaataaaatgtatcaagcacatactacatgataggctctgtattaggtacccatgtgcaaaatagacgtttcctgcccttgagaagcgtacagcttagttgagaaatttactagtcacataaaaccacaaataaatgtataaggtaagctgtgatactgctattatgaagaggcacaggatgctgtaagaacacataaataggggtttcaatgaaggcttgcttaaggtgttaatattagaattgagctgtaaaggatgaaaatgaattgcttagatgaaagaggtgacaccagagggagcgggcagggaaagggggagagtgttccaggaatgcagagagacagtgggaagaaatgaggtcatttaagtggccaagccaggtcaagctgggcttgttagtcactaacatattttgttttttatcctcagactataaagtatggaatgaaataatcgtatttgtgtacttaaaaatcactctggatgctatgaaaatataatgacattgagtactgctttcaataagtcacagtggaatcttgcaaatatttaaaataagtcaaccaccaaaacaagaattgtatttgagttaacagcatgtccacagaagggtttaattggattagagctttgaaaactgtaagtagaaacacaaattgcttcagagaatttataatcctggaatgatatttcccatgcccagagagaaacccattcctcttgttactgtcttcagaaccacagagcatgtcattaaatagcagcttagatggctgtgcaggcctactagggtgcagatggattggataggggtcaggttgcattggagtttcttagaagcttcacttcacctaacgttggcaaaacagctggacctcagagaactgcatgcacgaggtaccagatacacgaaaagaggcaaagcgtgacacagtgaaataacaggtactgatgttgagacttgtgaggtggcgcctggtttctagaccaggaagttttcttactcatctcttcttacaatgggtgaggcaccgggcacacatgagcgtatttaactttccaacagccatgtgaggtatagagtgtcagctcctttttaataagtgagaaaaatgaggtttagagaatttaaatactaatacccaaagtcatacggggcatgaggacaagattcagactcatgtctgccagctccaaaccaggatttatctgagcttatgtcactcatttaaaattggtatttgaattcgtatttatttttgaaggtgttcatacaaagaaaacaaaaagaaacggagtctggattgtagaaaacatataaaacctatatcaaaaatcatctaatagtgatagatagagaagtttcatattgaaataagcttttagaaaactgctctggtaaattaattggtacaaactaagaataaaaatgggatggttagcatagcttgtttgtcacaagaaacagaaacttcacctgcctttttccctgtgaagtgttggtgcagtgacaggattcgcctctcttattaatagtctgtcaaaatccaggaaaatcatgtgatgcttcagagatttttctactgagtgaatatatttgattaaacaccatctgcaaaaatcctcatcacccaagaaaataacagatcgtagatctaacacatgctttacatgtgtcaagaaatatgttggtcaaatcaagagataagcacataggtttatctgaagtccaacttaaaacagctgctttcaaattccttgctaagccaggaagcttgactgatgggacccagagtgatctccctgtctcccctcctagctgtttcttctcacctctgaagttactttttccacattgagggggcctttcatgagtaccagggagaatgagtcaattgagttcatgcaaaaaaagaatcccatcctttcaagaaaggagggagaaaagaggagggaaagaagatatttaaggggttttgctattttatctggcttaagttaaacttgtaatgtcaaaaaataaagtctgaggaaaatatgagtaaattttatctttccttgaggtggatcctttttagtcattggagcaaagtcaaaaactgtaacagaaaatattgataaatttaatataaaaatgttaaatgttattgtgtcagatgaagataaatacaattaaatttaagtgacaaactggaaaaataataatgacattaattacagaataagtatattaggtaaataaaagctcatagtttagtaagaaaaagataaatgataggaaaaaaacgaacaaaggatatgactaggcaggtcacaaaagaagaaataaaaactaccaagaaacatttaaaaacatttcaatcttgttggtgttcaaagccacacagatgaaaacaatatttttgcctatcaaattaatatatttttacaatgtaacccccattgtttatgtaatgaaaaaggcacaactttccttattggcaagttggcaatatgtcacaagtcagtataatgtctaaacttatccagtaatttacctttgtaaaattgttcaaaagaatacttggacatgtatgcagttatttgtgctacataattatttataatggtgaaatatctttaataaatgtaatgtccaccaatagaggattggctacttaatttatgtactctgccccgatagtaccctgtaaactcagtttttaagtctccacaaatttatgttaatttttatcattcattgattcaataactaaatatccattaagtgcctactgagtgtgttgggtacccatgaagacacaggtgatccagcagtgggcaaacagaggaaaattcttgtcatactagagaaccaaatgattcaatgacaatgagtaaagcatgttttgcatcagatggtgaggagtgccattgagaaatgctgagcaaggatggggataatgctagagttaggtggaggaagggacagtgtgattttaaatagggtgttagggaaggcttagtgataaagtgacaagtgattcaaaactcgcctgatatgaggaacagaaacctgctgatatcagagagaagggcatcccaggcagaggaagggcgcaatggaagccttgaggggagagcatgctggatgtgtttgaataacagcagaagggacactgttgctgagcaaagagaaccaatggcagaatagcaggagaagaggttgcagagaatgaagagaaccccataggccattgtgaggatgcgggctttttactcagaaagggatgggaagctgttggagggcttggttgatgaagtgacattattttacttacatttcaacatcatcactctggacactgtgtcaagaattggctgaagggacgctgtggagccaaggagaccatttaagaagctattgtaataatgaaggaaaaagatgttgggaatgtgagctgttgtagtaagggtggagatagtagggaagggtttggttgatatacttgaaaattttatattgtttgaatgtcttaattttatttttaataagcaatatgtttacatgattcaaaagtcaaaattattttaaaagtgcatacacacagtccagtccttctgaatcccattttattaattacctatttgttcttccaatggttctttatatgtatatgtctactcctgtagggtgtgtgtatgtgtgtgtgaataaaggaaggcatcaaatggattatgctagcttttgtctccctttcttacccaaacatgtttgcatatgatataaaactgcacagtacttacttttctcacctaaaaatgtatgattatattttgaatatagagccaacaggactttctgaaagattgcattaaaggtattaagaaggagaaacatgaagtgtgattttaagtcaccggaagaagcgtgttgcctttgggataattgcttgttcagcatctttcttccctgacttaacgggagagaccatagctagatggttcccatctacttcagtaaccagtaaatgttagaagccgcatatttactgttgaataatgagtgattgataggataaatattgtatacataaactaaaagagaattcaagtagcaggataaaatttgttttcatatatatttaatgttttgagaaagtgcttctaggactttggtgaaataaatatttgctctgcttatagaacgtgctgcagatacacagagagtatgttggtatctatactttaaaaatttgctgaaagtacatacacaagaattttaatagtagttatctcttggggttgggattatagatgactttttttttgcttcattattttatgtcttttctgatttatttattataaacacattttttatatttttattttattattattattttttaagagacagggtcttgctccatggcccaagctggagtgcagtggcacaattatggctcactgcagcctccaactcctgggctcaagtgagccttcctcctcagccttctgagtagctgggactacaggcgcacaccactgtgaccagtgaccagttaattttttaattgttttgtagggataggatctcactatgtttcccaggctggtcttgaactcctggtctcaagagatacactcactttgtcctcccaaagtgttggggttacaggcatgagccaccacactgggcctctactgtagacacatctttataaaattaggaagaagtgaaaaaaaaaaataagggatgtgatcccttatgtgaaattttgtttttcctaagttgaaaaatgatagaacaatgtgtaatgtgtacaagtgacaacaaaataaaggagagtttcactacttcttaagataaaccctggagcagactacctgaaaatattaggaaattttcactttagagatgcgtgagatcgggcagccagaaaatgacacagcaaggaaggactcctgtcatttgatgacactcatagtctgtcagggcattaatcagggtatagaaatataacatctgtcacaaattctgtgagatgttcttgctgatttcttctatatacagtgttattttgacattctgtatataaaatatggcactttttatccatgatcagattttcaaaatgatatctgtgccagtgacctacatttttgtctcacttgacaatgacttggggctctttccctattagatcatatagggaatgtctacctcattctcttttttgccattttcatggtacgatttatattatataatagggatgtgctataatttatctggtgtcttccatattggtagacaaatatatttgtcctcattttttactattacttagaacgctgtaattaatgccgcaaatattgctcaaatgtaatttctttacgatagtttcctagtattggaattgttgaattaaatagtatatgtacttgaaatttattcattacttcattcaaacatgcaacaaattttatgaaacatttactcctacgtcagacatggttttagaattagagatttagtcatgaacaaattaaaccgaattcctgtacttttgcagcttaaataccagtggcaaaaccagacaatcaataagtaaacgagtatatttttgtgagtatgtgtgtatataaaatatgaaaagagagatacagcagcatagcatcaaatagtgatgagttctctgaaaaaaaaaaacagcagggtttgggaatgaaggacaacgtggctgctgtcagttagggtgctcagagatggccaatgtgaaaagatttgacagaggtctggatataatgaaagaatctgaatttctggggtggggtgttccacgtgaggttctaaggcagaatcatccttgctgtgctcagggatgagtatctggagtgcaatgggcagtggaagaggattggggatcccagtggagatgtagtcaaaggctggtaggaaataccagtggagaggaaggtgggatagtagaaacgttggattttactctaagaatgatcagaactcattggattgttttgagccgaaatgtgacatgatctcatttgtatttaaaatataattttggttgcttttttgaaaaaatagactataacacagcagtattggaagcagaaatctcattggagaggctaccatagcaggctagacaaaagataagagtgccttggagtaattgttctaaacactttgggaggcccaggtgggaggaactcttgaagccaggagtttgagaccagcctgaggtacatagcaagactctctctctacaaacaaagttttaaaaaaagattagctgggcatagtagtgtgtgcctgtagtcttagctacttaggaggcggaagcaagaggatctcttgagcccaggaattggaggctgcagtgagctgcaatcctgtcattgtacttcagcctgggagacagagctagaccctgtcccctcccacaccaaaaactaaaaatcatttaaaatgttcataaattcagccacattgtcctccaatatgactttatcaaacctgtcttttgccagcagtatatgaaattctccttcccaaatcctcaaaagcagtgggtctccatcactttttttgtgctcggcatcatacttggcgtagagttggcctttgatcattatctgttgaatcgatgaatgaatttaagtgtcactattttgatgcttagcgatataaacttgttttgatttgcatggtttgaacttcaagatcttttcttacactgcttagaaacttgtttttcttcatgaaatacctgttcatgacatttatttattttgctcttagattttcttatgtatatgttggacttcttgatgttttccaggtattataactttgttatgtgttgtgtatgtggcagtatgtggtttttgtagactttatttttgtgtctttgatagtaccaagttgtagattttgatggatacattttatacatttttggttttgtgatcattttgggaaagttagcagtctttcatatccaatattttattctcactatttggttatatacagatagaaaaatgaagatttagcatgtttaagaaatttaaggacaaacaagttctgtgaatctcatggtcagccctttctccaaagggttgatttttcaggtgtgcttcatcatgtaatatgaaaaaacagaaagtagtgtgactggggagaatggaaggatagtatatgaagcatgattacaattttatttaatattaaaaactaccttatagctagatgtatggatgattttttattttccttatacgttctgtaatttccattttttcgaagtgtatgctgtgtgtgtgagagtgtgtgtctgtgtgtgtaatgagacattaaagtggccctagtccagcaggaaatgacatgtctggggcaacagggtagcaaaacttcagataaggaaatctgaaatgaacagatgcccaggcttgaacagagagtagaattaagtggtttttcattggaattatggagggagaatgaaatttctgaaaatcataatggaatgggaggaaaaaaagtaaacatagttaaaaaaaaaaacgatcatttaaagaagactaggaaatgagtaaaaagactgagggaggaaggggaattctaagtgaaacgataggggtccatatcacattgcatcctgttaaagctgtgtcaaaagtgtatgtttcttggccaatggagtactggatatggaagacatcttctagttagggcagcaatacatgacagacatcgataatcagtcagagccctccttcacttctttgctaagtcttcacagtgcaggtcttaagtaaaatgtgtcagggttgatgctcaaacataaactgtgtcccgcgtaactgtagttgcacgccctcattgtgaatataagtaagacagagaaagatcttgtcctcagtcgtccagctctgattatatctacctttaccaagtacatttcactatgattattttggtgctcattatccatttgatttctccttggatgattactttgtggagcaacagaaagagcatttgtaggatgactcaggaataaacctgttgatatagtttggttgcttgtttccgtcaaatctcatgttgaaatgtttccccaatgttggaggtgggcctaatgggaggtgtttgtatcaggggggtgggtggattccccatgaatggcttggtgccatacccatggtatgagtgagttctagctctggcagttcacaggagagctccttgtttaaaggtgtctggcacctcctcttctctctctcttgctccctctgttcccatgtgacatgccagctccccctttaccttctgccataagtggaaacttcctgaggctctcatgagaagcagacgctgacactgtgcttctcatatagcctgcagaaccgtcagtcaagcaaacctcttttcttaataaattatccagtctcaggtattcctctatagcaaggcaaattaaccagtatacctgcattgagttgcctccaggatgactggcctatgtgtccttgattgcttcatctgtaaaaaggcatgttgatactggacttactgggtagataaatccccattgttttttgatctatgcttctatgattcttatgagactgcaaccctagaataaaattttggcaaaatgatagcaaataacacagccatttataatggaaaactagagaaatttccatttaataagtcaaaatatgattttagagccagcatgaacacacatcagccatttttcacttctgtaataatattaatgtctacatttatttgctgtatagaaaatagtgctcattgcacattagttttttgagattcaggaaaaacaaatcatcagcactctttgacacttaatccatctcaatgtcattatatctttgaattaagttattaattacccttaattaaattcattttaaatggtggtgctttcattcctaagtgcttattttgtaattcctggaaaagtcataaattccactcagtttaacaaatattaaaatcatttcatgcaaggtatagttctagatattttaggtaaccactaatttcatatcccttggggtaaaaaaataaacatgcttccatctcttgtaactataacttctgttagagctttgctcttggcttatactttctggaagaagtaggggttggcacaggaatgggagaggaaatgatctcaatgattaaaagaaggatttgaccaattcctaagggcaagcaaacatcttgaagtttaaagaaatctcatacacgtctttctatagggagcattagatgatggataatgggctgtgttgccaacataacttttacattagatggtgtaattaatttttcatgattttgtttattgagactatgtatttagaatgaaattatatcagaaataacctagtgcaaggaattattcaaggccaaacttaagttctaatatgtttggtatctagcggcctccaggcatagcaggtatacagctaagaggcatggagcaatttcagtttctttaggcggcttttctctcaattatttctcttactttgtctttgagagacgcaagcaatctccagttgggcccttgggacaaggcatggtggccaatatgctaaatggcagctgatccatacactgtttctttctctctgtctctgtctctctaaatacaaaaaaaaagttgaaaattaaaaaaaaattttttttaattattctatttacctactcttgttatgtaagtgtggtatgtgtattacctattggcttcacttttaggtcatggaggacaatgatctacatcctaataggtggttttccagttttcctcagagtaggaaagattgtctaggaaaaatgaaaaataggagatgaaggtgaatgctaactcactgctctttgtggagagtgctctacacattatcattattattgttatttttcgagacagaatcttgctctgtcacccaggctggagtgcagtggcacgatctcggctcactgcaagctccgcctcccgcgttcatgccattctcctgcctcagcctcccgagtagctgggactacaggcacccgccaccacacccggctaattttttgtgtttttagtagagacagggtttcaccgtgttagccaggatggtctcgatctcatgacctcgtgatccgaccgccttggcctcccaaagtgctgggattacaggtatacaccttatttaaagccacaggagatgagaaagaagtgatggtctattcccaaaaccttaacaattatttctcctgaaggcataatgcatctttaagtgctaatattttttaaactgcgatagaagtatttcatgatgcgaaacaaatgctgtctaatggtgtggggctcataagtattttgcagaaattaagttgcacagaacatcccaggcatttcctgtagtagccacaaacaggtgattaggttgcctggggaaaggacatagcaaaggctttggttggtgacttccttgagttgcctggattttgcaaacagtggtgcactcatcaaatttttactgcagatgtgtgtatatgtgtgtttgtgtatatgtgttgataaaacgtgttgtattaattaatgaattctttatgaataatagactttatttttattttttatttttttttttgagatggagttccactctttcgcgatctcggctcactgcaacctccgcctcccgggttcaagtgattcttctgcctcagcctcccgaatagctgggattacaggtgcctgccacaacgcccagctaatttttctatttttagtagaggtggagtttcaccaggttggccaggctggtctcgaactccaggtgatccacccgcctcagcctcccaaagtgctgggattacaggcatgagccactgtgcctggcctagactttatatttaagagcagttttaggttcacagcaaaattgaaaggaaggtacagagatttcccatatacctactgcccccacacatgcaccaccttccacattatcaatatcctccaccaaagggatacatttgttattattattacccagaatccatagttgacattagggttcactctagattttgtatattctgtgggttttaacaaatatgtaacgacatgcacccaccaatacagaatagtttcattgccgtaaaaattctctgtgctctgtctattcatccctctccacccccaaacccctggcaatcactggtctttttactgtctccatgcatttgccttttctaggaagtcagagttggatttctacagtacctagagttttaaaattggcttctttcacttagcaatatgcatttaaatttccttcatatcttttcatggcttgatagaatgctgaataatattctgttgcctggatgtaccaccagatataggtatcctatatctggattccgactgaaggacatcttggttgcttccaagttttgggaactatgaataaagatttatttggttatgaatcaagctgctataaataaagaaatcaagctgtgttttatgtttcaatttcaaaaaatctaacaatttcatagaaaaatctgcatgcctttttctttggagaaatcacaaaagaacagtcagtaccgggaggtctgcaaggcaatccacagaggctgttgaagaatggcatggactttgcgtgggcctgagttctgcattcacagtggctcccatcccagtccccatcctcatacatcctgctcacacacacttgactcttcatgacacctccttatactataagcatttgagtttgcatctcctagggagatgggaactaattggttaattgttattttaagggttttgccttgccttcaacaaccctgggttcttggtgcatagtttgccctttatctcttcagttaatgttgctaagtcaagatttttatttggctggggggacggaaaggaatgagggtatgaatctatattattatagatagattgcattatatgaccccatatatgaccccagcatcttagaccctccttctgccaccttcccatgtggcagagccaagacccttctgcagctggtcctcacttctctttttccctcttgccacatgctcctacagcctggtgatccctgtcccatctcttgccaaatgttttgctctgagctaagtgagtaactaagtttcaaaggaagctaccatatttaatacagtgcatgaggaagaccaatttctgatttttgcttagccacagttttctttttcttttttttgttttaacctttaaaaaaaatgtggtaaaatatatataacatttatcatttaaccattcaaaagtatggtttaaccattcacgagaggcattagatacattcacaatactgtgcaaacatcaccactatctatacccaaaactttttcatcatcaacaaaatctctatccattaaacaataagtccctcttctttcttccttccctccccaacatccccagccttggtaacctgtattctactttctgtctctatgaattaggatgctttgagtgttctgggatctggtcctcactgtcagctaaactctccaagtaatcgtcactgcaatattatttttgttttgttttgtttttctggagttctgagagtgaggaatccattatcaatgacctatagcatgaacatttttgtgggggaatgtgtgtaaaggtatatagacatgaatatttgatgatctgacatcccacggtttaaacctagatggggcttctgtaaatatgaactcaaggctttaggagcctcccaagatctgacattccaagagtagagaagaatggagagacacccatgatggaattatctgttgcagacaagaacacaaagatagctttcttcatttagaactaactttgaggactttacatagacagaaatgttctgtctccttttttttttccagttacagggaatgttttccacttgtggtccctaaaaatgcagaaatatcatagggagtgaaagttaccttgtttctttaactgccgcaatctggcctcactcaacatgtagcaaatgccagaatgatagatgatagattatagtgatgtcgccctaggttaacagtctttctaggtaaggtacttctatatctgaattgaaaagtagggcagctattgcctcagatttgggattttaattacattgtttccacgtatgatattctttctaagaatgtctctagcacttagtctctgctttatacaatctaccagttaattatgtatttatgatgtaagtaatttggaggcacagagaaaggcagtggggccatttctccgcatggtcttggtctgggtgcatgtgccacatgattcacattatttacataaggaatggctttactgatttgaactggctgagtttgcttgcttttaaaactgcaacaagccaggtgctgtgccatgcacctatagtcccaaatgctagagaggctgaggtaggaggatggcttgagtccaggcgttttgagtctagcctgggcgacatagcttgagcccatatctaaaaccaaaaataagtgataataaataaataaattcaatttagatttggtttccaaggtacaactgtcaaacatctttttaaatgcaaatatttcatgtttcattttaacctaaggttgtgtcatccatttaaaatactttacagaaattggcctaactgcttatgtgtactgcttgatttgctttcctctttgttgttgtaagaaaaatgtcccactcactagtctggattactctgttgcaaaattaagggatctgaaacatctcaagctttaaaaatgtttgagcatagcttctcactaaaataatgagccctgtgtatctattgcaccgtaatctctaatatttaaaatgataaaggacttctagttcaaacccattattttcaattgagaaaattaaagtccactgaggtgtagtcaattgccagctagtgagtcaaggaagtgttaaggttatcgtcttatgctagatagagcctgggaaaggaggtgggtcttggaaatttgcggttcataacagggttgtctgtggggctggcagaaaggtagaatatgactctgtggatagagatcagggaaaaaataaagactgcagatttggggctgtatccatgtataggaaacatgagcctgacaaaaaatagagatgcagaatgagggaaggtgtggtcacttctgtaaaaatctttcaaacactgatttttgaacaattcattgctcttctgcagttgaaagaatcccaaaggaatgacacctgaatggaaaacctccaaagatcccttctggttggaggccctgggtctccaattgacccttcaaatatattattctgttcttttgtgcatttctctttttattgcaaagaaagaaaattaaaactatcatgaatgtatttaaaaattttattagtctgaacatgaccactttattgattactttattgattatgacattctttttttttttcagacggggtcttgctttgtcaccaggctagggtgcagtggtacaatcatagctcacactgtctctcaaattcctggactcaagcgatcctccctccatagcctcccaaagtactgggattacgagtgtgagccaccatacctggctgattatgaaactcttaaataccactcacacacatgacttaaggctatttttgatgatgtacagtagcactgtatccattcctggacaccagtctttgaagagtgtttggctctgtcccatatatacctattgatacaatgttttgagtgtttatttatgatataaatatatttatatttttataagtaatatacataattgctataatattaagtatcatgtacattatagggaggagtctcagaagtaatttaaggaagatgtatttgtttgtctccagcctgagtggtgcaactacatgagcttacagcattccttgaattacagatggctcatacctggggatacagattagcctttcctcctgtgaactgaaggcttccatttgtctaggtactgggtagagataattttagtgtctctttgaggaatattatctttagcaaacttgttttctctcttacaacctctcctttacaccatttgttaatttttttttttttttttttgagacagagtttcgctcttgtccaggctggagtccaatggtgcgatctcggcccaccacaacctccacctcctaggttcgagtgattctcctccctcagcctcccgagtagctgggattacaggcatgcgccaccatgcccggctaatgtttttttttgttttttttgttttttgcatttttaatagagatggggtttcgctgtgttggtcaggctggtctcaaactcccgacctcaggtgatccacctgccttggcctcccaaagtgctgggattacaggcctcagccactgtgcctggaccatttgttaatttaaaatgacacatttatggctgggtgtggtggctcactcctgtaatcacagcacttcgggaggctgaggcgggcggattatctgaggttgggagttcgagaccagcctggccaacatggcgaaatcccatctctactaaaaatacaaaaattagctgggtgtggtggcgtgtgcctgtagtcccagctactcaggaggctgaggcaggagaattgcttgaacctgggaggcagaggttgcagtgagccgagattgcgccactgcactccatccagggtgacagagccagactcagtctcaaaaacaaaaaagacacatttataatactagtaagggcacattcaatatttaaaaagaatctcatacagttttcatttttgcatattacttttcagtatattcattagagtcctaaaatttatactatcttgtattgtactcttttgacttcagaatgtcatcaaaaaatttgcttctgttaacaatataatcctactttcaattgctttttaataatcttgggtactttgagactgtaatttagctagtctccaaatttgggacatatatgagatttttttttttttttgccatcatagagaactctacatgaatcaggtttctgtctttatccttcatgcttctgttgcactatttccttggtgtgacatgccgtagtcaagaagtagaagcatgtattcttgtcattataatttcctatttttctgtgaacattttgaaatactgggttggtgtagctcttagctgtcactgtcaaatcacccccagtgtgagcccacacgttcaagattatttctctttttctcatttcaactctgagttagttccaggatatggttgtatctctgcaagattgtcagctccactgagtgcctccactcacatagatgagtggggtccctgcccagtgcttcaggtagcagttcttctctacacaatcaatgatgttaccactgcatgaagctccctgaaagtgtgcgtatggagtagtcctcgcacacaggctgaaagacatatctagctatgttgggcaactagtcccctcagaaaatgattgcctcaggaacaaatatttaagttgaattgttaagtgtggctgctaccatcgtcaatggaagagaaccaaagcactcgctattacaaaggggcctctagtggccaaaactctcagctctgaacgttgttcctttgtcctcctctctacatcctcctgagagaatggtacttcaagatttcatagggcaaatctccaacttccttttggaaaatacatgctttaccaggacgcatcatctgtccacgtgaggaacaatggaggagaccataatactctaaatctggaatatgtcagttgacctgaatgccatggggagattcagctgaccatataggataagcagggtgttgtggtctcttttgtgttgctataatagaatttctgagactgagtaattcataaagaacagatttatttatattgttctgggggctgagaaatccaaggtcaaggggctcacatctggtgagggccttcgtgtgagggcatcaccccatggtggaaggacagagggcaagcaaccatgcatgagagagagaagaaaagggggacagactcacacttttattaggaacccccttctttgaaaaccagcctactcccatggtcaagacattaacccattcacctcttttttttttctttttgagatggagtttcattcttgttgcccaggctggagtgcaatggtgcagtcttggctcactgcaaccttcgccttctgggttcaagcaattctcctacctcagcctcccaagtaaccaggattacaggtgcctgccatcaggcccggctaatttttttgtatttttagtagaggctgggtttcaccatgttggccaggctagtctcgaactctgacctcaggtgatctgcccgcctaagcctcccaaaatactgggcttacaggcatgagccaccgctcctgaccatcccatttacctcttaggggtcccacctcttagcactgttgcactggggattaaatattcaacaaatgaccttttaaaaggacacgttcaaaccacagcacaatggcactacaagttagtttccatttacaaatgagcactgaaaccaataagatttgggtaactgatatggaatcacaaaaaaaaatctaacctgaagcaattttacagtaagttggttatactgtcaactagtgtgacagtaatagaattggagtctcaggagaaagaatatctacaatgagttcatctctaggtattttgagcttttctttttgaacttcctctacgagagttttaaagtaagttatccatattttacagaaaacttcaaggattctagctggaaggagaagaaattatcaagtttctaaatatcagatcttactttattcactatttgaagtgatggaaatcagattgcagttcaatttttttttttaaagactgtactcctctcctctgccaaagctcatgcaaagccaggaaaacaaatattgatttttattttctctcatctctttcagtccaacctggttttcagtagtattgaaatcagatgtacttcatattgatctgggtcttgaaccagtataatccctgattaacacaattgaaataaccatcatcaaggtggttctaaagatagagaggaaacagtgtggacgcaatacatttctgctgtttgctgtggcttcctggttctgtgaattatgcattggatcttgggcaggaaaaaatacagccagatcctgccatcattttatgaaattagggtgagatatttggaagtagcacgcccatcaccaacactgtcaaatcattagtccatctgaatgtctggtaaatttaggtagaaatatttggtgttatcattgccttccaatctcgtctatctcaaatgctgtatcaatgttgactctgacaatagtaagggaaggctggacaatctggaaggatgggtaaggcttagcacaggtgaacagctgtatatataaccagaaaggcagggctatcaatttgagtcctctgtctataagagagggtgaactttacaagataaatatgccttatcctcagctgagcacagaagacccattaaagcaaaaaggtaactcaggcaataatcatcatggcttggtaaaaagcagttctgatagacttaatctttaaggcagaaggaggacaggctggtggttttatgagaaagtaatgaatccttttgacaattgtattaagactttatggacataagacctaagtcagagttttaaaaatggttctcagagacactgttttggctttgttcttagtcacatcccttcattcaggttagctatctgcctgccctgcaaagcccgcctcttttgtgaagcttttcctgaccacaccagtatctgctgatttatcatcttctctaatctctgaactaactgttcagagggatgaacacagtaaatactaatacatgccgtatacactccaccctctcccggcctctcaagttgtttgtaaactctattttatagttacagtccacccaacagtacaggtggactcagcaccatgtgtgtttaatttgttgccccactttgccagatccatacaacatcaatggtatcatatttatcattgcactgcccattgtctgtagtattctgcagtgcacatagtacaaaacattacagctgaattttaaagaatgatttaacattcaccagggaaattatgaaatacaatccatatgaaatatgtaatccttagcattaggacagcttctttctaaaccctgacttgtcctcacctctcaaaggtcatgtgtaatcctagccactctcaaatgtttttgtccactccaggtctcagcctattagcacatcctagttccctggccatgttgattggttcagaactagttacagtatccaattaaaaacaatgagatttttttcttgaggtatctgagaaaaagatgttcacatttcccggctggatccgaaacctcagagtaggtagggtctggagagcctgtcctcaacttgctcttccccaatgcctgggatgaaacagagtaaagtgaaggagagaaactgattcatgatgattacatggtgcattctacttccctgtaggatgtagagaaagacgattccctactttcctacttctcaagttatatgggtcaattgatttctttttcttttacatctttttcttttctccttcctttcttccttcttaatttcctgccttcaaagcttctttcatttctttttttatttaacttaagcctacttggactgtgatttctctcacttttcactaagagtactactcaatacccaacttgagttgatcctgtttctctttggtacaagagtacaattgtagtttattcatatgttcatagttggacaaattaatgtgtctacagcccaacggcaaactattgatataaatgcagtatctcctgtttttctaaatggtgtccagatttgtagagatacatttgtctatgttgtgagaattgaaagcctttcatgcataacttgaatgctctgtttatgtaagtaatttggcatttcttttcatgtgcaaagggttcctttgattttgaatgcacaggctgtgacactaagcagagaagatgagaatcagaccggggaagaataaatttcctttgtatatgactatacaaagttttaaaactttatctccctcagctcggtatttaatagacattgaagacaggaagtagggagctgtgactggctgtactcgacttttccccaatacagttattcaatttctatatatgctaccctgacaggcttatttcaattttagtcataaacaaaatttacgttttgacttgaagtgggtcaaaatcagtgtcagcattttgttttgtaatatgcccttcacatcgttgtacctttgccataatcagccagagtcagagaaaattatcatccctccctagtgggtgctcaacttaaaaaccagcagagaagatttttttttttgtaaagaatcaacaaagtatgaaaatgaaatgtcaaatgatgaaaattatatgattcaggtttgggatgctggatctttattttcagggacttatttcaaatccaggtacaagtctacagttagttttaggaattttagtgagcaatgggcaaataagttaatgctagtaaaagattgccatattactgcattttgttattgaaatgctaatttataagtagcaaattagcatttaaaaagacacaatttttgttaaaatagtggcctttcttacattttgtattagagctttactttttttctgctttaagcttcacaatgcagtggcagcttgtttcacttgagcgttcttattgattataactgctggtatgaggcaatctgtgcttcccttgtgttctgcctaacagaggttatttctttgcatgatatggagatggatatggaagaatctgggctgtcagggaaggaagtgagagccagagaggagaaagcagccagggggtggagtggtgagcctaattcccagctcttagacaatgagatagctaggagcaaacctctgttcattcttgcctgacagttgtcatggcaactctcaatccagtgacctcttttagttctctaataaacgagttgaatatttgttaagtttttggtttgtttgtttttagtatctaattctctttgagatgatcaagctgcaaactgattccataccttattgattcagactttgtaaaaagatattatgcaaagttgaagatgtgtagatttaaacatttcaatctttcttttaagagaattttctccacaataggaaggcatgtgggcattttatggtcttagccaacataagcattacacttatgaaattggtctagccttctaggctcctgccccagtgaggtccctcctcagttctgtgatcataggcaagtcagttccctgccccagctctttgccctcttccatggcatggtggggttgaaattgacagagtcacatttcccttctgactttaaagctttctgactctgaatacataatatataagtgggtttctctttttgacattacatactgtagtgaagtacagtcctgtaacaggcatctgcagactacagacgcacgttaccatgcagattgctattaatgtacagttctctccatttaatttgctgtggtttccaagactactatattttttattgagaatactaatagcctgtgtgaggtatgaaatgaatacatagtttcaataggactgggttagtgactgttggagaaaatatcttgaattagagtacactgttttattgtttatagctatcagaaagttctcctgtgaggacaataatataatgatctctatcctactatgtgctacactttatttaattggttgagatgaacatatgttgattaagaataaatttttaaaattttactaaatttgagaaaagcaacaaagtatgaggaaaacatatatgccaacaactgaaaataaaaagcaggtgattccattgttttttaatgaagcaccagtcatttccgttgggattagaatccattgtgctaggaaagtatttacagcatgatgctgccatatttgaataaagaagggacgagtggattgcctaaatggggttgaaaccatgtcaggagcacattacaacataaaccagaactcagctgagtatccaataatgttaatgggggcaaaacaagacttattaccatttgaactctatatctgaaatgggaatccgataacatggcagaaataacgtttggtttgggactaaaaacatcctagagtgtatctaagggcttaagtattcatgaattttgtttgtacacttacattatgtgttgtgttagaaaaggcagaaaaaggtagtgcttcatgtttggttgcaaagactcctgcctcagccttgttacacaggagcataacggtgcagtgtgaagcatttaagacaaaaacgttttagagtcagatctgagtaaaatctgagatttcacacttccagcagtgtaacctaagactagtttgttttttttttaatttctcctgaggcaaaattttatttttttctctttcttccatttcattgtaaccttttaaaaattgtgataagatatacataatatttttcagtgcaaccattcaaacatgtggcttatccattgatcggtagtcttagatacattcacaatgtcgcgtaactattatcactgtctatgtccccgattttcctatcatctccaaaaacaactttgtaaccatgaaagaataacttctccttctcctcctcctcatgccacctgcagccatggtaacctctattgtactttctgtctctatgaatttgcctgttttaggtagctcatgtaagtgtaatcatatatttgtccttcagtgtctggtgtatttcactaagcatggtttcaaggtccattcatgttctagcatttttcaagatttccttcctttttaaggctgaattggattccattgcatgcatataccacactttatctgttcatctgctaaatagttgatttggttgcctctgtcccttggctgttgtgaataatgctcccaagaccagctgtacaaacagatattcgagtctctgatttcaattttgtgtgtatatgccaaaaaattgaattgctgagtcatatggtaattctatttttagtgtttttgaggaactaccatgctgtttccacagcagctgcgccattcctgccaacaatgcataggtgttctaatttctccacgttctcaccgacacttgtgattttgtgtttttattttaaataataaccatcttaatggatgtgaaacagtaagttggatttgcactttcccagtagtcaattatgttgagtgtcccctcatgcacctattagtcatcaatatatcttacttggagaaatggtgtgaaagggtatacagttttcaaggttgaaacatgacaataattaggatgattggacaatttagtgaagaaaaaatattattactatagttaacatttttttggcacttattccgtgccaggctgttactaatgctataagtgcatgatctcaatcaacttttactatgaagttgaagactatgaaggtgcctttattatgatttctattgttcacttaaagacatggcatctcagggtcaacaagtatcttggcttatgttgcacagcttgtaagtggcagaaacctgatgcaaattagttctgcctgacttcaaagcatttggctgttaactgctatgccatgttgtctaatgcgtggcttgttgcctaatagcctgtcaatatatgttaaaaatccattatccccaccctcaactgaacccacacacacacacgcacacacacatgcacatgcacattcctcaactttcaagcaccattttcatcctagtataaaatgatacccacccaccccctacccaagattcccaatcttcagtcatctgtcatgtaatttcattcatgtgccttggagaggattccctaaatttatttccacaaagaagcatatcttaattaggtctgttgggagatcattctacatgggtctcttgtatttctgtttctatagcaggagaagcactatgaaatttgtttggattatatgttgaaggacatttgtagagcaaataaccttggagaaggagatactatgtctttcttccagtatattaaagacaaggtttccatttggggaaaaagtcagggcattttcttgcagcccagtgtaaaagatccaggttcttgaagattggaattcctcagctttgacacaaactactaaattgggcagcatctgcctggactgcttggtgctgttgctgccatggaacataaaggggtgagggaaactggtgcaaacatgaagtgcatattacttgtcttttttctttccatgtgcaatgaaggcccagaagtcttgggtcttctgccagcattcatgaaactgtggcagggtcacctgttagcttgcaagtgagataaagccttagactcattactcttcttgtcaaggtctaagatttattagtagccttccatgcacaccaggcagcatgctttacctatatcatttcattcatgcactctgagatatttactgttatcatcctcattattcagataaggacacaatgcctaaacaattaacttactaggctgtctgatacaatgtgttcctcataagtcaaatgtagatcccacagcaacttggtatatagcatctgataacttgaactaaacataccatttatctggctaatacacatgaaggtgtagactcatgtacgcaaacattttgtacccttctaccattgtgaatcttgcacctcaggtgccaatctctttaacttgggttatgagaaattgtagttaaagttggcagtaattaataattttgagcttattccagtttaattaaccatatatatgtaattactggggcattatgaaagacttctgacattgaggaaatagatatgaaagcagcatccatacgcacttgattctcacttgaattacactcattgctcatatgccaggtggggtgtctcacaacaacccacttcttgtatcaaataatgcatgtgttagaatccataaaacatgaatttctaatcatgtaggccacctcttcactggagaatcttctctctaagctttaggctttatatttcaatagaacattttaatacatatctagatgattaaatataagccttccatgacagtgtccaggtgggagaacctgtcaggggagataatttgggagtggagaaccaatatttttggcagccaccactgacataccctaacttgtcttgtcaactgtccttggtttgagacactgagtgtgtggaaattgctttaatgcctttgaaatgtccaaaacgccaaatattacttaaaatgtaaagcctcttcatagttaacaaagagacattaaccttctgctttgtaaactccatgtaaattacgacacaaatgtaaggtattattatactcacatttattgacaatgaaaccttttactaggtgcttttggttcatattgaaagagactttgagagccattaatggatattaaagaggtgtaatttaaatatgtctacataataaaagcatgaaattagaagtatattatctttttatgagatttgtatgtttgtgatggccttatattgaattgcagtcactaatcatcagagaaatgcaaattaaaaccatcatgagacactgtcttacagcatcagaatgactattattaaaaagtcaaaatataacagatgccgatgagcatgcgcaaaataggaacacttgtgcactgttgctggaaatgtaaattagcacaatctctatggtaaaaagtatgacgatttctcagagaactagaaatagatctaccttttgatctagcagttcccctgctgggtatctacccaaaggaaaagaaattgctatatcaaaaagaaacctgcatttgtatgtttatcacaataggaaaaggaaaagtacagaatcaatctaagtgtccatcaatggatggttggataaagaaaatgtgatgtgtgtatatatatctgtcacatttcatggcgagatatatatatcacatttcatggtgtatgtatatattcagccattaaaacagggtgaaatcatgtttcttgcagcaacatattaatagatgggactagaggtcattatcttaagtgaaacaactcagaaacagaaagtcaaatactgcatgttctcacatataagtggacctaaataatgtgtagaaatggacatacagtatggaataatagacactggagactcagaagggtgagagggagttgagggctgtgaaattacttaatggttacaatgcacattatttgggggatagttacactaaaagccctgacttgacccctatgcaatatattcatgtggcataactggacttgtgccccataaatttatacaattttttttaaatgaaaaacctggagctttcccttggctccttttcctggaagctttctcacatcctactgtgtgaaatttggatgcttttgggaacctgaagataaaggctatagctacaccttaaggatgcccaagctgtttctgtaaggagactgagcttgtgaggtttttaatagaaaaatgcgaactaacctagcagccctggacttcatgtttctgtacttttacatgggagaaaaataagctttctatcttgcttaagccaaaaaaaaaaaatgagagaagcattttatttgtaaagatggtgttggggagcttgactgcaatattctgttcacctaatcactaataaaataaatgcaggaaagctaaaagtccacatgagtatcactagcatcagctaaatcaagaaggctggggaggggcagaaaacaatgctatacatttcaacaattgctgatcagggaaacagagacaaggttgaggcatcaatcctattcctggcccgattgctcaagttcactaaagtctgagaattctcaccgatattcccaaatctgaagtgaagtgaaatcagtgatatcccaagctgacctgaactagctgctgggaaaggaccagtgaagtgggaaacaggaaccagaggctaattctctgtcaatgcatcaggttctccagggctaacaggaatagtgttaaaacttaactcactcttccctctctgggaatgagctaaatctcaatactaagcagagtgaatcctgcacagcaaattaaacaaattctcaaaaagggagcagagccaaggtatgccagccatgaatgaattgacagtaaactgagcacttcaacgtggggaatcttcaagaaatgttcagccttcaaaatgtagctggtaggggaaaacaaataagtctcatatgcaaataagtagaaagagagactcacagaaactgacctgcataatgtcatgaaagtgaaaatctggacagcattggcaagacgaaaaggaacagaatggaaactataatcgcaattcgagccagtaggtaggtgggcaggaacaaattgatggaacatagcatggaatctgtaagaaaatgtaacctaagacggaagaaaattttcgatactttatgctaaaaaatacatgaacatggctgggcacagtggctcatgcctgtaatcccagcactttgggaggctgaggtgggcagatcatgaggtcaagagattgagaccatctgcgccaacatggtgaaaccccatctctactaaaaatacaacaaattagctgggcatggtggcacatgcctgtagtcccagctacttcggaggctgaggcaggaggatcgcttgaacctgggaggtagaggttgcagtgagccgagattgcactcctgcactccagcctggtgacagagcgagagtctcaaaaaacgaacaaacaaaaaaaaaacaacaacaaccacaaaaaaaacatgaacatgagttaaactggagccccgtcactcaccaaaaagaacacaacaagaaaaagagatgaacaaagagagtgagaaacttgaacaaaaaatattgaagactaagataatacaatctcaaaatgactaagtaaaattgacaagcatatagaacaaatataactgaaaattgacttattgatatggaagacaggcatatataaccacagccaatgaacatacaagaaaaatataaagcaaagagagaaaagatgatagtttttcagagcttagaaagataagccaacataataatccattgcctatgagacagaaaagcctacacatgaaattgcaaaaggtattaaaatataatagaataagccctgatttatcccaagataatgcctagttagattattttctttgcacagatttaaaagaaaaaatttaaaatttacatacagtaaaattccctttttgaggtgcagttttctgagttttgacaaatgcatagagtaactaccaccacgattagatacagaacaatttccttatcccaaaatttcttttgtgttacccatttatagttaattcctctcttttttcaatctctggcaactgtgtcgctataattttgttacctgttcctataattttggctttttcagaatgtcatatgaatgaaaatgaacactcttgagtctgaattctttcacttagcataatgtatttgagaatcatcctttcatttattaatatgtcttcatatttttgctcagtgatattcaattgtatctttgtttcatcatttgtttatctattcccttattgaaagacgtttatgttattttcagtttccagatggttacacacacacacacacacacacacacactcccagatacatatatatatatctgtaatatatatatatatatatctgtaatatatatatctgtaatatatatatgtgatatgtatctgtaatatatatgttagatacagatatatgttatatatatctgtgatatatatatataggcacacccatatatataaagctcttatgcacattagcatatggcttttgggtgaacatacagtttgatttatcttaggtaaagacctaggagtggaattgctgggtcatatgatacatgcatgtttaacttcataagaaactgccatactattttgcattatcaccagcagtgagtgagagttcttgttgtgccacattcctgacagcatttggtagtatcagatgtttttgtttgttttttaaaaattgtagccattctaatacatgtgtagtagtatgttgtggttttaatttacatttgcctaatgaataatggtgttgaacatatgtttgtgattatttgccaccagtatatattctttgataaagtctctgtttgggtccacttttaatcgggtcatttgtttccttatcatttcattttgaaagtagttattgttaagtctgaaaccgagaaggatctgagaccttatcctattgtgagctaacaatgtagtctgccacatatatacacacacacacacacacacacacacacacacatcatatatatgtctcatatatagatgtctcatatatagatgcctcatgtctcatatatagatgtcatgtatgtatatgtcatatatatatataaagctcttatgcacattagcatactggcttttgggtgaacatacacagacatatagatgtcatctatatatatatgtcatatatagatgtcatatatatatgtcatttatatatatgtcatatatatagatatagatgtcatctatatatatgacatatatatagatgacatctatatgacatctgtatatgagaaatgaggctttctggagcagaaaagcaaacaacttattgctcttggcaaaaacagccagagcagcatcttagtgctgctccttgagcccccttggggtggtgtagtgagaatcacaggtctttctccacatacaatctgtgttagagggtacagtgtaggagaagacgatggatacactatctctagcttccaaggcattttctattcaaatagagcccctgctcaagaaacctgtactgtgcagaaatatgaaaatcttcaatgagaattttctcccagtaagcatatattctggatatggttcttttttgttgttgttagatatgtgatttgcaagtatttttcccaatttgtggtttgtcttatttatttatttagatagcatctttttttgtttttgtttttgaggcggagtcctgttctgtcatccaggctggagcgcagtggtgcgatctcggctcactgcaagctccacctcctgggttcacaccattctcctgcctcagcctcccgagtagctgggactgcaggtgcccgccaccatgcctggctaatttttttggtatttttagtagagatggggtttcaccgtgttagccaggatggtctcgatctcctgacctcgtgatctgcccgcattgacctcccaaagtgctgggattacaggcgtgagccaccacacctggcctaggtagcatcttgacagagcaaagattttaattttataaattatgatttcttttttctttcatggattatggttttgctgttctgtataaaaaaaactttgcctaacttactgtaggtcatgaagattttctcttttttctcaagttttataattgtacattttacacttacaactatcaaaaattttgagttaatatttttataaaacataaaatttggttaggattcacttttttgataactgattgttccaccaaaatttcttgaattgcctgtgtaggaaaaatcacttgaacatatatatgtgggtttctttctggagcctattcaattgcattgatccatttatcaacactttttccaattccacattgtcttaatatggtagcttttactatggtagcttttactaggtagtcttgaaaccaggtattgtgagtccacaaactttgctgtttgttttcaaagttgttttggctattctcattcccttgactttctgtcaaaattttagaataaacttgttggtatttacaataaactctactggtaccttgaggtattgtgtagactctattgatcaatttttaggaacattgatatcttattaatattgtctctaagctgggcactgtggctcacatctctaatatcaacactttgggagactgaagagggaggattgcttgagcccaggagtttgagatcagcatggcaagacttcctctctacaaaaatgtaaaacaaaaacaaaaacaaaaaaacaacttagctggtcccagtgccacatgcctatactcctagatgcttggaagtttgatgggggagggttgcttgagcccaggagttcaagtatgcagtgagctgtgattccatcatggtactccagttaggtgacagaacaataccctgtctctaatatatatatatatataatttaaaaaaacaagtaaaatattgtctcctgttctatgaagatggaatacctctttatttaattaggtcttctttaatttctgtcctcaatattttgtcacttccagaatttttgcacattttttatttgatacactagaattcaattttaatggaatagtaaatgttgcttatcttttatttccaatatttcattgaaaacatattgaaatatgacttttttggattctatggctttgctatattaccatattacttccaggagcttttttgtggatgcctttgaacttcctatgtagacaatggtgtcttctattaataggaacaatgttctttctatcttccaagtctttgtatatctccctcttcctttttttcagccttttattgcactggctgggatgtttattataatgttgaatacgatgatgtataatggactttcttcctttgttcttgaacttaggagaaatcattcagtctttcaactttaaatataacagtagtctaagcatttgttttcttttggtgtgagttgcatgatcaggttaaggaagttcccatctattttagtgttctgagatttaatctgtcaaatctgtcagttttttgtatatattttgatatggtcctgatttaacttagtctcttactatggtgattgattgattttaaaatattaagtcatctttgtgttaccaggataaactatacttggtaatatatttggtattaccatttatatatagtgctgtttttggttttctaatattttttgtgcatttttgtgtctgtgttcaacaggaatattggcctgtcattttcttttactaaaatgcctttgtccttttttattaggaagattttttttggcctcataaaattgagaagtgtcttagaagagaatatgtggaattgttatcatttgttctttaaattgttagaattctccagtgaaatgatcgaggtctggagttttatttgttggaaagtttttaacacacattagttctttagtagatatagaactcttcaggttatctgttcttgagtaagttttgctaatttgcctcactcaaggaattggcacatttcctctatagacacagacagatttgtattattctcttattatttttcttttaatgtccataaggtctcagtggtgttccttttgtattcttgatactgatatttgtgataactctctttgttttggtcaatctgtctagagtttcatcaactttattatttttcagttaaagcagcttttgatttaattgattttctcttttgcttttcagttttctatttcagtaatatcaacttattattgacaccattgatatgtttattatgtatttccttctgctttctttaggcctaaattgctcctcattttctagtttcttatgacagtagcttaggttatttattttagggctttcttattttctaatatgactcaatgctgtaaattttctgcaaatattaatttagctgtcccacatatcctgatagattttatttttatttatatttagatcaaaatactttatagttcattttggttgtcttacttaacccattaattatttagggatatgttagcttctaaatcattgtggaatcaccaatgatttttatgtaattgatttacagttcaactctgttatgctaagagatcatactttgtatgactttaattattttaaatttgctaagggttgtttaataagcaaggaaagggtctatcttggagaatatttcatggttacttgaaaatgtctattactgttggattattttctaaatgcatttacatcagtttggtcgatactgtggttcaagtctcccatattgttgctgattttctgtatgttgtatggattaatgagagagaagttttgaaatcttaaagaataatttgggacttttccatatctccttccagttctatcagtttttgtcttattttacagttctgtatatatgtgtgcgtatatatatatatatacgcacacatatatatgcacatataaatgtaatgtgtgtgtatatatgtgtgtatacatatatatatgtgtattcatatatatatatgtgtattcatatatatatatgtgtattcatatatatatatatatatatatatatatatatatgaatgtaatgtcttcttgggtaattgagccttttattcatcaagtaatggtcctcaatatccctaggaattttcctgttttatagtgaaatttgtctgatattgatatagccatcccatcattctttggtgtttatatagtttaactttctcctttattttacttttagcctgtccatgttattatatttaaagtgcatttcttgaagtcattgcatagtagggcctttttttaatgaaatctgacaatccattttgttatttgttgttgttagatcatttatatacagtaattattgacatggttttatttaggtttagcttttttattagttagattttttttccctccatttttgttccagtgttcccactttcctgctttttgggggcattatttgaatatttttatcatgatattttaattattggccttttgggatatatattttatattatacccacacaaataaatatacacacacagtatgtgtaggtgtttatatgatgttactctacataaatatacatttctaacttttcacagtctacttaaaagttaatacctttttttactgcaaacaaaatcgggatgccttccaactgtatagatttttaattttcccctttatcttactattgtaataaatattctatctatatacattgaaaactccaccatatattttaattttaactttcacactaatgcacattaaaatcagagaaaaagtctactatattattcgatatttaccattctgttgttctgccttcattttggaagtttgaggcttctcactaatattatttttctttcatctgaagtacttccgtcagcatttctttcagaacatatttattcttgaggaattatttcagactatcttcatctgagaatatctttattttatcttccttcttaaagaatatttttattgggcttagtattctgggctggtcttttcttcagcactttaagtatattgttttatgatcttcctgcctccatagtttctgatgaaaaattcagagtcatgattttttcattcctttatatgtaatgtgccatatttttgtggctcttttcagacatttggttatgaggtttctattctttgtatagaatctattctttgtatagaattggtagattcaaagtaattttgggttgagttctgaacatattgtgacattatggatctttcaaaaatcctctgaatgatattgcttgttttaaaagcaagcagtcaacttaggtttggactgtgagtgttgtctcaccttctgtgggtgattgatccaatgtcagttatgttttaaaacctttgttactctatatttgactgtcctaaaaatacatcactcttctgttattctggaacttaggtggtattttatatcatatttttactttcaaagcctttgacatgcttctttgggtctattacatgcgtgttctacttagcagtggctcagaaattttgttggtttatacacagaattaagcaattcttgtctctagctctctctgctccaagattcacctcaaagtctgcagctctcaagggcctcctccagttctgaggccagagagatgggttttttcctttggcttttacgtgcctgggctgccactaccattatcatcacaggagtgcattctgccaccgggaaagacaaggtgagaaaaaagaagagggaaaagaaacaaacaaacaaataaataagtagggattcccccatactctatggttcatgggggccctctttcccagcgatctactagaaagatttttctcgtgcctttttttttttttaatttttatacctgctgtatgtgttttaattagtccaccctcatgtcaaagttgggtgttaaggaaataatttaaaaagtgcactttccctcatactgtttgttcttcaatttttttgacttttgtctctcatttgcctgccaatatttacttttcagaagtaattttctttttgtatttctgttcagagattttagccataatcagtgaaagaggttggcaatagcaggcttatagcattttggccacagcagaagcccaggttaggatattaaacttataaattaaagaatgtgttagctatacagccatgagatgctggccgcttaataggagaatactgggccagctcctgtcatctctatttcaacagattgttcttaaaaaggagaaaatatctacacatatcagaggaaaagagagtgggatacaaaataatatatatttggccaagctgtcatttaggaagcagggagacaatatttgtaaaatttgtaaaaaaatcaagaactttgttgccactatccgtcttcagtaaaactgttcttagacaagataaagcaatatgaggaactctgaaatgttataggaatgtgctgtgtgaaaaaggtagtcagcatttaaaacatcaataaagaaatacagaatgaacaattgtggatattatggttatgaaataaaataaagcataaatcttaacattgtttattgaagatagtatgtgttatacgattgcaatttaaaaaatatgtgtatcaatctctccattaatatacctgtctgtatttaaatttgcatgtgcatatacacatgtaaatttatacacatgtaaattcacacatactacacacacagatgttagaattgaagctttatagtgttgattatgaaaaggaattattgcttttataatcacataaaacactttaatatcaaacacttaactttatttgagctggtggttttacatgtttcttttgaggacacatttatatttaaatctgatgcttaacctgtaaacatgaagggtttcatatggaaaaataaacaggttatggttgtagataatagaggaatatttaggaatatacaatattttctgaggttatagataatatttcactagaaaaacgtgaattcaatggaaatagaatctttgttattaaaaagtattggagctattctatggctatggaatacagattatgatgggctcatcaattttcattatagaattggcagattcaagtgcagcaaagtttgaacataatcaaaggtgcactgagttcatctgactgcctcattacctgtttgcatcctgtacaagtagaaagcccgatattgtaagctctcaattaactgaatagggtttgttcgctagcatcaggtattataaatttctctctaacttgagtttgagtagtatcagaggtagtgtggagtaagtgatgtcctccctgtatcttcccattcttctaggataggggaccctgtctggcattgcagcattaatatatgtacatggaataagttgttgaaagataaaagtagatactttgctactttgtgtagaggaggttcttgttatttgtattgtgtttgacatttatttgtttgtttgcttgttgatgccctacgtcatcctctgaatgatttgaggcatctgtaatgaatacatacactatctgtccatttttcttctctctgtttcacataatcttacaatttgagatattatcaataaattacatgtcaatatgaaaatagacataaatgataacaatcaagaacactgagataacagggataaaggaatgtcaaaaacattgacaattaggaagaaatagaaacatccagaatttccacgaatactgcagatatgacgcagtaaaatccaagacacactgctcggtatgcaaagccttatgtcatatttaatggcttttcagttgagtgatggtgactgattccatgcatccatgacctgagggatatttattacaacaaagatctgttcttctggggtctagttatttgggcatctgatttagtgagcacatctatttccaatactttccactaaccttgtattgacagttttagacctgctgagtccaaggctgacatagaccaacactgcagcctagttagcaaggcttatctaaggcaactgagtgttgaacagaggggcctgacctttggtgacaattgaaatgtaaggtcagtcagagactcagtactgaacattaagccaaatgaaccagctgtggaaagggttaggctcaagctgtgaaaccaggagttcctccaccagtgttgctgagccaagggcatagatgctagaagttagacccaggagggttcaccacaaggccacagttcatatcaactaattgtatactcttaaatacaaatcaggcttataaacccaggatccctttcagaatctcaatcacctaaggttaggctagttgttaagctcatttgctctagatttttattttgaaaatgcataattagactttttttttttttttgagatggagtctcattctgtcacctaggctggagtaaagttgcacaatcttggctcactgcaacctccgcctcctgggttcaagtgattctcctgcctcagcctcccaagtagctgggactgcaggcgcgcaccaccatgcccagctaatttttgtattttgggtagagacaggttttctccatgttggccaggctggtctcgaactcctgacctcaaatgatccgcctgcctcggcctccaaaagtactgggatttacaggtgcgagccactgcacctggcttaattagacattttttatccagggatctacaaaaatatttctgagaagatgcactctgctataaggtatcttgcaaaaagagaaatgaaaacaatctttgcccaaaatgttacacagttagatttaatatagtcccatttggtgtagcaatttatttccttctccacttaaagaacccctgtaagctaggcattgtctaaggcatgagaggagctagacatgggcacattattcaaagccatacaaaacattaatacaggtggataatctattatttgaaatattttgggaccagaagtgtttcagattttggattctttttctcagattttggaatgcttgcattacacttactggttaaccatcccaaatctgaaaatccctaatccaaaatactccaatgaacatttccttttaatctcatgtcggcattcaaaatgttttaaattttggaaacttggattttggatttttagattaggatgattcaacttgtaccagactgaatagaaaatgtagcaacatgctaaggaagtcataaataggataaataagatttagttgtgaccataaatggaagatgttgctgataaggaccatgaaatctggaagatccaacttttgcgtaaatagcacatgtcacttagaaagcatgtattatatgccaatttctgggtactctccacagactattttacttattttaaaaaaaattttacaggtggaaaaacagaaaaaaattaattttcccaatatataacaaaacttcagtgatgtagcagaactaggattcagatgcacagcttgaggaagttgcatcaggcttcttagatacttgtagaaaataaactgtatgatcattacactattgttgcacggggctagtcatttagtaggagcttaatacatttctctttttctgtaaagccatctttctgtctttgttgaatgaatgagtgtaacaatcactgtggaaaatagaggagggagtcaaaaaaagaaaaatgtatgtttaaaaaacagagtaaacagttgagtttacatagcttcctttttttctcccctaaactgtggaaatatccaggtaaggttggtaagtaagagaagctgaaaaacgaaaacatcaagggtacttattaaatgagggtgatggccagcttatccattgccacggctgacgcagccgtctgtgaggtctactttggcaatttgctctttagagatcttttctgtgcatgggcttcctgcctgaggttggatctgttcaacatggccttgccacttaaatgtgacaccaagccatctgatatgcccagatgaagaacgacaaagtaatcagataagtttataatctcaatgcacagttagaaaacatctggctattacagatgatttagactcatctatgatattaatattggtcttcatcccatgatatttccaggacacagacaggggtattttgcaagctgttactgatctatttgctaatatgtaaacaaattttcctgtgctcttctggatgattgtagcacagagaattgatttatagtgttttgtcaagacctccaatgtcctagattgaacaagtgagtgctgacttagtgtgactgtactggaagtctgtgaggagctggagataaatggaaatgtcaccaggatgcatggatgcctgtctctctgctacccttcacttcctctttccttagccatgaagctttgctaattaaattgaccttccttttttgataatctgaatataaatattgacaccatgctcagtattgtgagacaaacaaggaggatttaggctactaatgtcaatttcataaataattgattgcaaaaataatgaagatagtagtagttgtagtagtagaagtaattacagtagtagtattagcagcaagaataatcctagcgttcataatagctagcctgattgttgggtaggagatgagcactttgatgttccttacagaaggtttgcttagcaatgagtgaaagctcaggcagaagagtaccatgtggccacagcctggatatggtatatttatatttacccagagtggcctctgatccaatctccttatccccagttaattcctgctatatgagcaacataaattcactcttttaataacaaaccttgggagggctaactctctgggccattacccttcactagaatggaagctacctgtggacaggggctgggttttattcaccagggtatacctaggggacacccagtacagagcctggcacacagatgggattgatgcacatttcttgaataaaagaaccaattatactagtcgctaatgtcagaagaattatgatgtggtcaacttatttcctgatgttacctccacaacagccaagtttccaaggaatgagtagaacatgggagattccaggcacagggctcttggtcttagggagcaaggttgagctacaggaacatggtgagtgattgaagaaggccacaggaaagccaaacgggacaatcatctggacaaattaagttccagattttgcaacaatcatgaccatttatttagtcaacactttagtaggtacagaaaatactgctaagcgctctatcctattttatctttccagtgaatagatgaaagcagattattattccaattttatagttaaagattccaaggtttatagaggcttattgtgttgctctaggaaacaaagctaaagaataagattgtgtgtgtgtgtgtgtgtgtgtgtgtgtgtgtgtgtgtgtgtatatatatattttcagatcaaattgattccaatgctctgaacttaaagcaccaggttacactgagtcattagctagatatttatgtttatactgtccattgtttctgactttctcttcaattaataataatattaagtgaccatttagtgattttcaaacactgtaacatgtaatttcctgaatcttcgcatttaatcctcataacaagccttcaaattcagtactagtatccccatgcagcaggtgcagaactaaagaacacagtttcacagtttgaccaagatcgtgcagcttgtaagcaatcaacttggcacttgtgacctggctgtctgatactagaataagtgctcttcttaatcactgtgattcattgattcctgaatttaactaatttttggtgacaatatgctaggtaatggaaaagcagtggtgaaacaacaacagtcaaattcccttctccaaagacaatacacaaaacaggtcaagcatgtctgtttgatggtcataagtgctacagagacaaaattgggaaagggtaaagggaggctacaattggaataccagggccaggaataacctcgttttgccaggataagaaggttacaattgagggagccatacagatatctatggtgagtatatattgggccaagggaaaatcaaataaaaaatcctttggatgagactgggcctgatgaaggaaagaaatgggtgatcatatggagtgaacatgggtgggtggtaggagatgatgttagagagataacaggagaccagattgtataaaatgttgccagccacttcaggatttgagcttttatgttgagtgagatcagaagccattggagaatcttatgagaggaataagactatctcattattaaagtggatagtgtgttgtcgacagagcagggagaggtaacaacggaaacacagagacgagagacgaggctattccatgaaatgatggcttggaccaaagtggtaaaggtgtcagggaggaaagtagtcagatattaatatagtttttttttaataagtgagattttgttatgaattgaatatggagtaaggaagaaagagaggagtcaaagagcaactagaaggtgaggagactccagggagaacagtgtggggagatgagtaggtttatgtcagatgtctttatatctattagatgtctactagacatcccagtggaggtatcaaaagggtaatggcctacaggcatttgaaattcaagggagatgtgtggatcagagaggtaaatattgaagtcatcagaatatagttgttattgaaagccattaaatcaggatcaccaggcaagtaagtttagatagagaaaagaaaaaaaaagtgctgctttcaaagttactttgctaacaaagatgttaccaaagaggattataggaattctctgttgtgcttttgcaacttttctgttgcaaaacttttctgttgcctgtaagaaaagagagcattctgtgagtctaaagttagttgaaaatcaaaaattttgaaaacatgttcccacatgtggacatactcccttgggttggatctggcctctttagaaggaaataagatacttgcttattttggtctgaaccccagactttattcagaaagcttatacttgaattatcttcttgaacatcttatcacttcgtcagcttacactgagtttgtggtcaactgagttccaaggcatattctaataatctcttcttaaaccaggtctccctcattgtatctttcaaaaatgaatttactttttgacaaccctgatgatagatcatacattatacataataaatattcttaattgagtttgatacaaacacgaccgagtgctttgggctctgctttcagtgtcatagcatttaccagttaattagcatgccctctatgctgttatctgaggcttccaacattctgtcatcttttagatcactggagaaggtccagggaagcataggtactcacccagagtcagcattttcattgaccaagatctatccatgaactcttttttgctttcatccagctgtgaatttacctaccacaattatccagcagcccacatttattcatgatattattaaatatataatgagggtctctattaaattctttgatgaaataaaaacaccatctgactataacatttcttagtctaccagcccagtaggcctatcaaattatgaagcttgtcttgtcttgactaatttgcaatgaatttacactttacactgccttctagtgatcaatgtattttgttattatagcaccacaaatcatctatttaatagtccttttctactaatccaataatatgaggttgctcatgtgaattatgcaaatataagaatgtcttaggctgggcatggtggctcatggctgtaatcctactgctttgggaggccaaggcaggaggatcacttgagaccaggagtttgagactatcctgggcaatataacaagacccctgtcactgtaaaaaaaataaaaaacagctgggcatggtggcacatgcctggggtcccagctactcaggaggctggtgcaggagaattgcttgagcccaaagttcgaggctgcaataagctgtgatcacatcactacactccagcttgggcaacagagtgagaccctgtcttaaaaaagaaaacaaaagaaaacaaaacaccttgcctaccctttctgttttcgcttattattatttttttatgagaagaaacctggtagacctaacataggggtcttccagagaggtgcatactgtgaagttgtggggttattctttttttaggaagatgagggaacaggcctcataggaatcaaacagaaaatgttactgcctttgtttccgattttatgggcaatagctgtttttgatggtgtagttaaactccacaggaggcagtttaaatggcagaattaaatgtagtttggtgaaaatgtttatcaagtattttcttaaacagtttataatttgcacatttcttttctaaatggcgcttcttcattagtgcagactagagcttgctacagactgctaatgaattatgacacatctattattcatggatcttacaaatttaggtgacattctgaaggtcaccctatggtttataatcccaaatgatcttgttgaagaagctccataatgtcaccaactgtaaccatagtcacctgatttttgccaggtcgtgaccatgctttgtttgcaatggatatgtatttcagtgatatcacagcctcctgagagaaggcacagtgctcagacaagctgtaatggctattctgtgtggtttcatgtggccatgcctagtataggttgtgccccatggttgatgaaataagatgcctagctcatcttctcccccacactgctcctggtcttcctgcatgctggcctcagtgtattgttttctgaaacaaatcatttcttgatttgcttatatttaccaagattttgacagaattgaagacagttggaggaacttgggataatagtaatgtagggattgtaaggcattcgggaaaataaatagcaacagcaaatacttttatgctccaggcagtgggctaaatgcttttcatgtgttatctcatttaatccccacaacaaccctatggagatgggaactgttttacaggtgagaaaactaagggcagaaatgtcaaattgtccaacatcactgagttgttcagtgataaaactgtgatgccagccgttgtcctatggtcccagagcccccgctcctgatcactatgcagtgccaccacgtagcttttcgctgatggagaccatgccaaacatgaattctaactgtgtgttcagagatggtgttcagcaattttaatgtgattagatgcaaccgtgtgatactgctgatatctgactatttttacataaaaagatgtggtgatttgggttatgaaaaactgagagactgaggaaatgacaacaattgcaagcaactgagaagacctgctgaatcgatgcaacatgatacattggattggaccctggaacagataaaagacatcagtgaaaatactggtgacatctgaataaggtctatagtttagctcatagtggtgaaccaatgtaaatttcctggttttgataattgcactaggtaagatgttaattttaggggaagcaaggtgaagggtatgtgaaaatactctgcagtatatttgcaacttttctgtaaatctagaattattgcaaaatacagttctatttagaaagtcaaatcaacagataatttcatgtggtttaaccttaattatatatttacaaagatcttaaatatttgtaacaatcacttcttatttaattatagaaacatgtatgctttctttaattatcatcctgtaaccaccagccttctccctactccccagctctaggcaaccactaatctactttgtctgtctatcagtctccctgctctggacgttttacatgaatggaattctgtaatatgtggtcttttgtgactgacatctttgatttagcgtaatgttttcaaggatcattcgtctatcatcactttgttcctttttatggacaaacaatattccattgcatagatataccccattttgttcattcatctcttaggtgatgcatatttgagttgttcacaccttttggctattatgaataatgctactgtaacattagtgtgccaatttctttgtgggaaaatattttcatttcttttagatatatacttagttttaattcaattacttctaactcgaccccggaggaaagtctcttggagagaaggaataaaagaacctgaacgtgctaaaaaattcaaattattttcagagattactacctctgtgagtctcagtttattagcatcctttatagataagctgtgcctgtaagaaaagaggggtagtaaacaaacacgtatacacacacatgcttgcacaagcatgtcgtcaaaagtgtctccttcaaagaagacttctggagaaaaaaagcataaaccttctcaagctattgccattgttcgggaaattgggtaattcatctttaggaatttcttctgactgatatttggtcatactagaaaaactgaccatttctaacagcttttgcccctgcttaaacaagattgcttctggccatctctaaaaattaaatttcccctggaaactgttctttcatgatgtgtttttggaatattggctgtggttaggagggtaagctcctcaagggccaagcctgtttcctcctttctggcagagcaccttcatacaacgcaagtactcaacgtgtttgctaaactgacatcaattgaaatcattgaatcatagcacttttttggaggacgtgtctgtcttctcaatcgctcagttttcttttggaaaaaggcaggttatagagcaattcattaatcatttgctgtcccaatgttccttcctgcttttaatagcaaaaatgagtcaagacctgatcttctgaacacatcacttgctgcctacatgaggcagtggagacttagagtacccctgtggcctgctcctcctacatctcttcttttgatccctagtccttgctgaccttctgtagaggcttattcacccagcttgtgggttgaggtgatgctttcttcctatttactgagagcttccccacctctccctagatactgcataaatgcaaggaaatttccaagaggccccttcaagtataaccacagcttttcaatcatttgacattttggtcatagagcagaaccaaattatgtagtcaactatagacaccatgcctgattgaaacttgtatcaaaaatcccaagaactccaataactcttagttttactttgtactgtttttaaggaggctgatttacagcagccttttttctgaattttatttgaggaaaaatatgccctcctgccatcattccagctcctgtgacactgaggcctttggttcccttacttatatcagggtatctggggcttggttgttaatttggtgtaatgtgattaattgagacaggcatacactcaggcctaaaagataatcaaatccagaaggggaaactgaggtcctgaaagggaaaaatgggcatttacactagagtcaaaagtggatatcaggggtttggtcctgttatagaaaagttctttttctgacatttcttgatgttctatctagcctagtggactagcactaagtactgggtgactgctcagtaaatgcctctggtgggcagatggcacagaagtgcttaggggatgttctgcctcatacagagcatccaactctcctacatggatggagactcacatgatcctggtccctgcagagaaaatctgtgcatttaccacaactttgactcctaagaagctctgactttttgactaaagtcaatgggggtattttgtcagcaggcacctttaaccaggctacacttacaaattcttgtaaatcaaattttgtacaagtagatacttttataacccatcatattttaacctcaacaaagtggattctttacatccagaaatgaaacaataatgactacattattccaaaaaaaatttttttagtagttagatccaggtggatttgatggcctgattttgtcccttatactttgatatatagtatccctttatttatttaccacaagaaaaaaacccttaaaaggagggaaggagggcatctttaatagccaagcttaaaattaaaggcgactgaaatattaattcttaaacagcgctctggtttcctgagtagccaagaaagcactatttagctctttttttagactttacaggaataggaagtgctatgtatcaacatttaatttagaaactatgaatgctttcagatatgccatcttaaatgtttttacttagggtgagggttatttcagtgacatttactttgtttttgggcataattagaggatgaggatctcatataagtgcattttaaaataacgaaagcttgctcatttaagagcctatattttttatttcaaatgtttctgaagtaaatcttttaaaaatgtaattgtccaatcatttccttttgtaaacaaaagtgtttaatagacatataactcttcctaatggtccatggcaggacgcccaagtgaatctttgtgtctgggaaacttagatttgaagagaaccccagttcacccagtccatctccctcatcttcctgcccgatttatagaagaaagatttgaggagctacttccagccaaatgccctgagatttcttcggtactcttctccttccagacatccatgacctggagctttgctttcattatagaagtgctcagttgctcaggctttgccctcaacaagctgcaacccactctctttctagggttcacctcaaggagctgctgactggcccccaatgcagccccacaatgtacccctacagctcttgcacacccacttttctgtctgggattcctttccatctggtccaccttagatggccgatagccaccttgctttatctgtcataggtcatatttaaggataatttcctctggggaactttccaactcccccaggcggaaatagttcctccctacattacatccttgattttctctatgagttctcctctctcagctcttggccacatttgtaccataccttgagtgtccatctgtctttgctcactcactcattgagcttaaggattcaatccaactcatctttcctgttcccaatctgataactagcagctctctatggggataaattaattgtgggacaaagaagatactctaaatccacatcactcactcacttccaatccctctcagatgagcttcttttaatttaattcttatcaagttcttttaatttaatttttgtcaaatacttgatatcttgaatgatgaggagagaattggagagtctctgtgtgtgtgtctctgtgtgtaggaagacaagtcacatattctcaccctgagacatagtttttttctgccagccaaggagaaggagcttcctgcccatcagagaccccaccctttttacctggcagggtgtgctgtgaggcattgcccagagtgtcttgtgcaacttggggaaacgttgaaatcacaacctacagctaacaggaactactgaaccttacagagttttgtagcccatgcctaatattaatatactctgtctcctagatcacctcaaagtagtgaattttagctcttttgtctgcatgtctgcaccatgcgtatttgttgccatttgttttcattgccattgtgaagccacactgcctgtgcttacatttcgccttcattacttgatcattcaacctctcagttcttctgtttcctcactgataaaaatggtggtgtaaagactaaatggattattgtacagaaaatgttgggaagagggccggtagcaccaacacagcctgaagcatgctcgctattattactgttaagatgactgtccaacttggaaccctcacttcctgactcactgttattgtcttgggatttgctttgtctaccctctggtagctggtagaatcagactggctcaattgactgtaataagtaaggccagagtgattaggcttttagtaaggactctaaaaaaaaaaaaaaaactaaaaaatctatatgtgctctggagcacatataattttaggctgtgggttagcatccaggggccctcttttttcctttctgattcatgcctctgttaagaatagtcgaagttgccagaaaagtgatttttgtataagtaagagaggtgagatcatgttaaattaggaatcagagtcaagaaaagatgagaagctttatttagaatgagatttgggctgaaaatgactgtagatgtttttcttttttaatagtgtgagaaatacagccacaggtttgaaatggaactatttaaacgtttattttagcctagttgaaaaaagaagagagccagtctcttcctagacctgaacaatttatctttaggatgtataaagaaagtgagagactgcatgaccttgttttctctgaaattttcgctaccttgctttctgtctcttttttgctttttttgaggggggataatgtgtattgttaatgctgaaaatagtaaatgatttttttttctttgcaatagatgtggaaagttaataaaaaacaggcatcatagcctatgcaagtgtgttacagagtacagctaggtgagtgactcctgatgagccttttctccatagttctggaatcccatagactgatcatatctagatccagagttgcctatagttggtccttcaaacaggctggcctgtccgcagaacatttacagacacagtctggcctctaggcaaagttctcaactgagtgtcctgcttaaaggcaagttgtgaatttctttttaatttttattttattgtaaattgacaacttataatttcatgtatttatgaggtacaaagtgatgtttgatttatgaatgcaatgtgcaatacttaaataaatgtaacaaatatatcaatacatcaaacacttattttttgtggtgagaacatttaaaattatgaaaagatgaaatattgaattatgaaattatgaaatatacaatactgtattcttaaccatatttaccatgctgtgcaatagacctcaaaaccactgtaacaacgacaacaatgtctcctatctgaggttgagtttggttcttgaaatttgtctctctctttctttctctattgacttatctagctccctgaatatttttactgatttcacaaaaaaagttataaaatgatggaaggttttatctgccttgctcatttaatcttcacaatagccatgttagatacacatcattacccttattctaaagataaataaatggaggcatgaaaaatataaataagttacccaactttatagccagaaagtgttaaagtgagaactatagcagggtctttctgaccctggggatcttgtgttcttggctactcactacctagaaaccctaaataaattaagttctaaacttatgagatttttgccaaatgatacatagctgccaaaaaagaaccacttgaatttggacaaatatattcctgtaaatatacagggaggcttctttatcttttgacttgttatcagcttgactctcttattgataaagtggcaccatgttgagaaagagtgaaaataaagttttatgtgttacagtatttctaaaatttggaatgacgtttctgaaaacacgagcacctcttgtcctcctttctgccatccttgaatagaaatgatatggctggaaattcagggtaatggagaaagaaccctgtgctatttgtcacgacctctacttctgtgattcctccccctaaatacaaagataatgttttaagggaatatgacacagttacttcctaaaataaatgaagaattttaatgtaaatgaacgtattattttaaagaaagatggattatgatggtctgttggataaattcaggaaaagaactctttgcctaaaattacccagcctgttcaagatgcagtgatatatatggaacagctcctccacagaaagtccgagccgtttcttctcccagaaagtgacccagtaaaaatgctaaatatacacccaggtcctctctaactgtataggcaataatggaaagagatgactcagccttgtaacgacaggagacccgtggaaatggtttcttttactggagttggtctaaatttctgttttgttaaaagttttaggctatttaaaatcaatagtaatatttaacctatattttacaaaaaagaaatacatttgtttctttaaagaagttcagagatagctgactaatgagcttattaacccagggtttataatagaatgctgaaattatacacaggataagatgcatgatacctccttggctttggttttcttattttttcagggaatcacataagtcaagttagatattaaatttgcctgtatacatttatttttaaagaagatgtttcaggatatttcaattgtactgtctacaaagaatacctctggcatccaaaatggaattacctcttttgagggaccaaattgcacagaaaaccaggataagattctatctagtcatacaaatgcaagaaggtttgcttggcatttctgtggactaatattgaattccatggagtcagttgccaagagctggagattcagggtcatggatatgcttcccacagctccttctctgcatacggggagtctcattactgcctgtctgtattcctgcacatgcctccgtacccatgtttctgcctgtttcttcttcttcttccctttttttcatttgctgaaataatggatgccagtttaacttactttgttttgaagcagtacgatcaaaatctgttccagtgtacctacagcatccccactgccatgatgtaatatttgtctccatcattccagttactctacagacagttccaactggtaaattctctggtgctcgatgcctcagtgaaacttacccatctgctctgtgtaactccagtaaaccctagattccaccaccacagtttagtctggctgcaggacattcttcctcttacaccctcttgctcctggtgacatcataatcatcttctaacattggtcctcaatttcacccacctcccagatactttcaaaggagttgtatgagagagggatggggcatagactaagggacacatattggatctgccattgtacctgtaagcaattgacttgatcaatgtcttggtttcctcagttttaaacttggaagaaatagtccctcaaagagagaattcaggaacataccctacatgaactgctttctgcagagtagacagtaatgaggggtcaattcctgttttcttcccaacactcactgctttcctcattaggattgcgtgtcctctggtgctactagagaactgaacattgcatcgtttgaactttagatgacatgttagagttttgggagatattggggctttgtgctgactttttggttttattttattttgttttgtttttgagacaaggccttgctctgttgcccaggctggagtgcagtgatgaaatcatagctcactgcagcctcaaacttctgggctcaaacggtcctcccacctcagcctccagagtagctgggactacaggtacatgcctggctattttttaaattttttttatagagatggtgtctcactgtgttgcacagactagtttcaaacccctgggctccagcaatcctcctgttttggcctcccaaagtgctaggattataggcatgagccatcatggctgtcctgtgcttacttcatgtgactgttttataacaaccccccaactccaagcaggaatatatgttttgcttctttctgttcctagcagtatgaccttgagtaagtcattctcaaggtcatactgtggttcagtctcatcggtaaaatgaggctaacaatagcactgactcttgagttgctgtgaggattatatgaattcacacacgtatttagaatagtgcctcacatggagtaagtgctctatccctttatgtttaatagtaactgattttttaattataaaaccttggtcctctgtggttcttataccaaactttttgcatgggtagggcactgatcttcttcatagcagtcagaaatcccatcattttagccaagttagttttttccccttggcatttggtttgctgctggcatagtatttgcttttcctgcttttgcttatggcacagatgcatgagttagcatgactcggactggtatgttagtgtgtttttgctccgtagtttgtcttcacagatacttggtcaaacttggccattacacagtctgatgatagctctgtttcctttatgttatcattctttcagtaatgagagttgaattctttctctctcctgcctcagatcctcaggtgacattgcacaagggcagctgcagccaatgccttgtccaggcagttatattagtgttatttctagacattgtctgccctgaatacctgttagcttcctgatcttggcatactagtctgaatgagataaaaggaaacataatggtctccagtgtataggattatttgactaaacaggaacttgccatgtgttatgtgtgtcaacaaattctcatttttcatgagttctttcaactctcttattaatttcctgtgatacaagctaatatttctggctctacaacccaacttctttttactacatgatgtccgctgtcattataacacctcttaatctctctttctgtctcttcctcaatccccaaatctgctctgtgttacctgctcagatttctctataagagaatagatcctaagccaaatattactttggcagtgaaaaaaaaaaacacataagaacaccaagtgaaaagctggtgaaatggattcacgtggaactatctttaaatcttggcaccacaatttttaccttgggaaattatgaactttggtctcctatgttattttaagacagaataagtagtatacccagagtacctgttacctttaaacatggctcagtaattgaaaggcatattactagaagtatttggagataattataatacttggaatatcaacagataaaaatactagttgatttttcccctgaacttcagagacactcatttgacctccaaaatagaatgccttgttcttgatactcattttttcgtttaatacattcagtgttcctgctgcaggtgccaaatgccagccttgagtttcgtgcttttaagtagaggtatagaaaacacagagcttatggagcccactctttctcagtttatgttactttcactgtgagcacctgcttactgtttggcaaactagacataactgttcagcatctgacggataaccctgctgaggacggacactggcatcctcctccaacacctccttctgtgttcctagtgtttgccctcaaacagtctccctgcaaaggtgggagcacctgaaactaggattgaagaattcagttcatccaaaattctgttctttcttctgctggtgtcattagtttttgaggcaagtctaaatcaaccaaatatagagtctggaattctaatatagtagatctgaatgttggctgaacagtggaatcgtctggaaaaccttaaaaggtataaatgcctggtcccaccccagagctctggagcatctggatctgtatgacctggaaggcagcaattggcattagtttcttccttgctttgctccccgaggttgcttgcattgacaggggaaaccaatttcatttgacatctgatactcaggactgccccgctattctcacccccttcaatgagatgcatactaattagatgtcaagaaaagatcaaatccttcagaccctcaataccactattgcgatgtcatttcaagtattttatctatctacttcatcacagtgatctgctttagatgataggtaacttgttttatctttgagattatattggtagcttaaatttcttggttacatcaccttgaaaggtgtaggttattgggaaattctgaataggatagcgttatggagaattggctttcgaactgatgaatcctgtatttggaatctaccatctttggcaggtaacttgaactctttgggactcttcatccacatctgtaaagtgggattaatagggctgtagtaattattaacttacattggatcagatatattttgtgaaaatccacacctaacccttgcctggaatatatgaagttctcccaaaatatatactttttaccccaatgagtaaggataaaaatatttaacaagtttggctaacacaggaacagaaaaccaaacactgcatgttctcactcgtaagtgaggcggaactttctgttcctacagggaggggaacgtcacacaacggggcctgtcggggggtggagggcaagaggagggagaacattaggacaaatacctaatgcatgaggggcttaaaacctagatgatgggttgatgtgtgcagcaaaccaccatggcacaggtatacctaagtaacaaacctgcatgttctgcacatgtatcccagaacttaaagtaaaaaaaaaaaaaaaagtttaacaagtttggatgccaaatatatgttttctaaggaaaaaaataccacagtataatctgttgctttctttcagccttgtgtcattcatcacagactatttacttgacacagcaaaacatcatatcatctaataatggcccgattgtcagcttctcaatagaccaatcatcatccccatttgacaagcacattttactcagaaatgacatcaaaatgcaatatttttcttgtcaagctgaactatgccatgcctactgactcctgtatattctcaatattcattacccttttacttggtctcacccttttgctgtcaaatcgcctcattttatttatttaataatctgacaaagatgaaagaaatattaccatgggcttatgagacaattgaaatgtcctttactgtcatcattttcatttagatgagagaggcatcccccggtcatgaatttaatttaagcaatgtctgcgtgttgaatgttttgttgtgcagctgtgtcagtgtgtgtgtttatgtgtgtgtgtgtgtttccaaaagtagtttcctgaggtagactttatgtacagccctcagattaagtgatcttcaccaaactctgctctttgttatattgcaaagacattattttaaatcattcagtctataaacctgaaataaaaccttactcaattctaagtggatgtcatttaatcaacataaatcatggctgtatatatttaacattacttaaattctgttaaagttttttgaaaaatgataactagctgggacacctctttttagtaaagataaattctgaagatcttaggcaagtgttcttcaacaaataccatcaatatgctggttaaccccaaatgtatatttttagtcttgacttctattataaggcacagactcctatatcaaattagcattgctttctccaaaatattgaactcatatgaggtatgtctgtgtggctgagatcatactcattatcttccctctccaggtggttccccttccaatgtccccggctcactagaccatgcttatatattctgaatactgcccagatttgtgtaattttctttatcttcaatgttgctaattcaagtcaaggcaccgtcaggtctccctggacttcagtatgctctgtggaagaaagatgtcattctctctgtttagcaattaatctattagatagcaagattattttttcaaaaggcctgtagggagaaagacaaggtgaaagatcttaattgtggtgaccatgaaatttattttacaaacaaggacgcttaagagtgaagggagcaactactgataattattccaggactatcgccatagaaaagattagtcccaggaaactggggtgttggacagccagatcttaatacttttcactagaaagtgaatttcaccattaatgaagacatagacttgaagaattaatgtagaaatgatcgataccttagataataaattaaatatcataaggttgttattaccacttaggaaaataaatttatttttctttaacaaataaattctaaaaatattattccctataatgtataatgagtaaatttaatttttttctacaaacatgtagaacaaacttgcagtaattatagggttatatttcatagaagctgcaacatgagacatacagaacaaaagctgggtggttatgaatcaagccattctagacaatcttttggcccagtagatgtcctagtagatgtttcggtagatcagccacaagttggtgatgacaaggcacagatagtatgcagagatttaattgaaattatcacttcattctgactgctgctctttattctttatagtaattggcatataaatattccttgatgccagaaagaccaaagaattaatttctcctttggccgcttctttgaactggcattttaacctctctacacattcatgtttcttctgttttaaggaagtgatgacatttattctgcctacttcataggactctaggaatatttaatggagtagtacagatgtgagttctctgcaacctgcgtaagttctttgcaaatgattggtgttatcataagtgctagactaccagcagcaaagggaggcctattttgctggttcataagagcccaggttggagacacagttggcagtacagaagggtgccctagtcgtaagctagacaaagccttgctcacagtcttcctctgtcacaatgttataacagtttcagtgaaatttgagatatggcattctcatgactatggtgagaaagttgttttgacttgttgttcaatccttgagcaaaaataagcctttcctaaagtctgcatgctgggtccctaacacttgaaggagatccatgggccatgcggcttcagctccatgcagagggtggctgcaggtgctgcaagggcagcttaagttctggacagtcatctctgttcaatggaatttgtaaggtcaaaaagtagacttaaaaccaaagtgatggggctgggggagtggagaggaatagaccctgcctatgtgaagttagtagtggaatagttctctcctgaaggtaaacctagttttcaaattgctttgtttattggttggcttctctacctgcatgaaaagtttatgcgttttagaacgtggcaaaacaagtggagcatgacttatgtttcataatgtacagagctgatttcctgagttccaggacaatgttcagccctttagtcccttgagaagttggttctctctctctcttatccataccctcctgaaacatacactcctctaaaactcatgttatcaccagaagtgtgataccaaagcttagttaatactttgggcacagatatttggctaacttccttgtaaatatgcacagtaaacctgagtggaagtgtgccaccctttccttcttcccagttggtgccaggacaggtggcatcagcctatcctagccacctgtctccagaaaccccagtctgccccagggtggactccttagcccacactctcagcacagccactgatcttgacaatgcaaaatgcaagcatttcagagacatagtggggcatccccaccctgctaggaccttcctctctcccaccctcttcagtgcttggaggctcggctccataggaaagaaaaagaagagtcactctgtttccttcatcataggaaatttaactacctcattttcaaatcatggagtggttcagtttggaaaagcctcaaagatcacttaaggtactgaaaatttacaaatgggaaaattgaagcccataaatagaaatctcttggctaagatcacgatgttaattaatgactgagttggacttgtgttcaggtctgctgtctagtcattggccttccttctacccgtcgtgattccaatggaagataaaatgtgtgctgggacacattttatcttacctagttccggacaatcatctttattaataatgcaccatcacttaagagtatgtgcataatggcattgcatttattttctttattgatcattatgaatatttcagtgctatttcatttttctaaggactgtcataaatggctaggcatgttttagagatctcaccttaaaaatgtttttaaaaactcaaattgtgtcatgaatatggaagagatacttttcagcagttgctggaaaatgacatgtgcatcccttatattaaaactcttactttctatatgccttcccagtaagtgcctcctgtactccagagaaaaccatttagaggttagattatgataaggaaatgccttttgcatttgttgtggaatgaataaaggatttatatctttaatgctgcattgaacaaatttgcagagaacattaaatattctttaccttgacatttctgatacccatgattttgataacctttgagtcatggattgttgattacaaatgccttatatgcgtctgactcaaaatatgataagaactcaaaccagaagcatttttaaaagcttgtttaaatttctggggttttttttgttcacttcaattatttaaggaatctgaataaacagattagcttttccactttgagtttacaattagggactggaacatttcagccaataataaccatgttgatgataaaagcacactgtgtgtatgctgtcatcttaatttgcttgagatttcggtaccctaaatttttgaaggtggagtctcactctgtcatccaggctggagtgcagtggcgtgatatcggctcactgcaacctcgcctctcgggttcaagcgattctcctgtctcagcctcgcaagtagctgtgattacagatgcctgccaccatgcccagctaatttttctatttttaggagagacggggtttcaccatttcggccaggctggtctcaaactcctgacctcaggtgacccacctgccttggcctcccaaagtgctgggattacaggcataagccactgcgccagggcagtgctctaaatttttaacataatgttctcaatacacagtattcctgtaaaaaccacaatactacattgtcagagggcacagttcacattcaatttccagtgatatatctgatttttattacatgcatggttagtttaaagttagtcttagaactcctttcattctggtttccttatctcctctatagatttccttgttttaattcttatgggtacatagttggtgtatgtatgtatgaggacatgagatattttgatacaggtgtgcaatgcaaaataatcacattagggtaaatgaaatagctatcacctaaagcatttattatttctttgttttatgaacatttcaattatactctttcagttatttatatatattgttgagatggagtctcactctgttgcccaggctggagtgtagtgcagtcatggctcactgcaacctccaccttccagattcaagtaattctcctggctcagcctcccaataggcatgctccaccatgcccggctaatttttgtatttttagtagagacgggatttcatcatgttggtcaggctggtctcgaactcctgacctcaagtgatcctcccacctctgcctcccaaagtgctgggattacaggtgtgagaacccacgcctgtcctagttatttttaaatgtgtaataaattatcattgactgtaatcaccctattctgctatcaaatactagatcttattcattctatcttaactatttttttgtaaccattaaccatccccactttccctgcccattaaccatcactacccttccaagcctctagtaaccatcattctactctctatctccatgcatgcaattgtttaatttttagcttccacagatgagtgagaacatgcaaagtttgtctttctgtgctccactgtgtatatgtatcatattttctttttttttgcttctccattcatattcttttattctatcaattttttagactatatgtatgtatcactttttctttatatatatatatttttattatactttaagttctagggtacatgtatgtgcatgacgtgcaggtttgttgcatatgtatacatgtgccttgttggtgtgctgcacccattaactcgtcatttacattaggtatatttcctaatgctatccctcccctctcccccaaccccacaacaggccccagtgtgtgatgttccccttcctgtgtccaagttcatctgttgatggaaacaggttgcttctaaatcttggctattgtgaatagtgctacaataaacatgggtgtgtggatatctctttgatatactgatttcatttttttgggggggtatatacctagcagtgggattggtggattatatggtagttccatttttagtttcttgaggaacctctatattgttctctatagttgttgtactgatttgccttcctaccacaaagtacaagggttcccttttctccacattctcgccagcatttgttattgcctgtctttggataaaagccattttgactggggtgagatgatatctcattgtagttttgatttgcatttctctggtgatcagtgttgttaagcaccttttcatctgcctgtttgccattcgtgtgtctttttttgagaaatttctattcagattttttgcccattttaaaatcagattactggacttttttcctatggagttgtttgagctccttatgtattctggttattaatcccttgccacatggataatttgcaaatatttccttccattctgtaggttgtcaattcactttgttgattgttttctttgcagtgcagatgctttttaatttgatgtgatcttctttgtctatttttgctttggttgcctgtgcttgtggtgtattactcaagcaatatttactctgacaaatatcctagaaagtatccccaatgttctcttttagtattttcattgtttgaggtcttagatttaagtatttaatccattttgatttgatttctgtatatggcaagagataggggtctaatttcattgttctgcatatggatatccagttttcccagcactatttaaagagactaccctttccccaatgtatgttcttagcttgtttgttgaaaattagttcactgtaggtgtatggatttatttctgggttctctattctgttccattagtctatatgtctgtttttatgtatccatgctgtttgggttacaatagctctgtaatatactttgaggtcaagtaatgtgattcctccagtttttttctttttgcccaggttggctttgggtattctgggtcttttgtggtttccctatcaaatttaggattattttttctatttctgtgaagaatgttattggtattatgataggtgttctatcaaatctgtatattgctttgggtagtttggcattttaacaatactgattcttgcaatccatgaacatggaatatctttattttttgttctctctgtaatttcttgcatcaatgttgtatagttttcattgtagataactttaatttctttggttaagtttattcctaggtatttaattttatttgtagctattgtaaatgagattacttttttatttctttttcagattgttttctgttggcatatagaaatgctattgatgtgtgtatgttgattttatgttttccaactttgctcagtttgtttatcagtagtaatagtttttttggtgcagtcttcagacgtttccaaatgtaagattatatcatctgcaagcaaggataatttgatctcttcctttccaaattggttgccatttatttctgtctcttgtctgagtgctctacctagagtttccagtactatgttgaataacagtggagaaagtgggcattcttatcttgtaccagctcttagaggtaaggctttcagttgttccctgtttagtatgatactagctgtgggtctgtcatatatgacttttattgtgttgagatatgtttcttccatacccagttttataagtatttttattatgaagggatattaaattttaacaaatgcattttcaatatcaatggaaataatcatatggtttttgttcctcattctgttaatatgatgttatcgtgttgattgatttgcatatgttgaaccatctttgcatccctggaataaatcccaagtggtcatgatgaatgattgttttaatatgttattgaatgcagtttgctaatatcttttatatatatatgatatatatgatatatatatgatatatatatatgatatatatatatcatatatatatgatatatatgatatatatatgatatatatatatctttgtctggttttgttatcagagtaatacgggcctaatagaagtttggaagtatttcctcctcctcctctaatttttggaatagtttaagtaggattggtattagttcttcattaaatatttggtaaaattcagcggtgaagccgtctggtcttgggcctttctttgctgcgatactttttattacagctttgatctcattacttgttattcgtctattcaggttttggatttcttcatgtttcaatcttggtaggttgtatgtatctaggaatttatccttttcttgtaggtttttcaatttattgacatatatttgctcatattaatctctaattattctttgaatttcttcaatataaattatgacatatctttttcaatctctgatttatttggatcttctctttttgtagttagtttagctaaagttttgttgattttgtttatttttacaaaaaatcaacttcattttgttgattttttgtattttttatttcaattttatttatttctgctatattctttattatttcttttcttctactaattttagattttgtttgttcttgcttttctatttctttaaaatgcatcattaagttgtttatttgaaatttttctacttttttgatgtaggctcttattgctagaaacttttctcttagcactgcttttgctgtacctcatatttttttaacattgttattttgaaaaacttttattttaggtttggggatatatgtgaaggtttgttacatacataaactcatgacacaggggttgttttacagattatttcatcacccaggaattaagtcccatacccaatagttatattttctgttcgtctccctcctgccaccctgcaccctcaagtagacccccgtgcctgttgtttccttctttgtattcataagttctcttcatttagctcccacttatatgtgagaacatgtggtatttggtattctgcttctgcattagtttactgaggacagtagcctccagctccatccatattctcaccaaagacataatctccttcttttttatggctgcatagtattccatggtgtatatgtaccacgttttctttatattgtctatcatcagtgggcagttaggttgattccatgtctttgctattgtgaatagtgctgcaatgaacattcacatgcatgtgtatttatagtagaatgatgtatatttctctgggtggtatatacccggtaatgggattgctggatggaatggaagttctacttttagctctttgaggaatcgccatactgccttccacaatggttgaattaatgtacacttccatcaagagtgtatttgtgttcccttttctctgcaacctcaccagcatatgttattttttggcttttaaataatggccattctgactggtgtgggatggtatctcattgtgggtttgatttgcatttctctaatgatcactgatattgtgcttttttcatatgcttgttggctgcatgtatgtcttcttttgagaagtgtctgttcatgtcctttgcccactttttgatggggttgtttgtttttctcttgtaaatttaaattctttataggtgctggatattagacctttgtcacatgcatagtttgcaaaaatttactcccattctgtaagttgtcttgtttactctgttgaaagtttcttttcctgtgcagacgctcttaagttaattagatcccacttgtcaatttttgctttcgtagcgatttcttttggtgtctgtcatgaaatttttgctttttcctatgtctaggatggtaatgactaggctgtcttccaaggtttttatagtttggggttttatatttacacctttaatccatcttgaattgattttggtatatcgtataaggaaagggtccagcttcagtcttctgcttatggctggccagttatcccagcatcatttattgaatagagagtcttttccccattgcttgtttttgtcagctgtgttgaagatcaggtggtcataaatgtgttgccttatttctggactctctgttctgttctattggtctgtgtgcctgtttttgcatcagtattatgctattttggttattgtagccctgtagtatagtttgaaggtgggcaacatgatgcctccagctttgttctttttgcttaggattgccttggctattcgggctcttttttggttccatatgaattttaaaattcatataaaatttaaatttaaatttatgttcatctaaattttaaatttaaatttatataaaaatttcagccagacatggtggctcatgcctgtaatcccagtactttgggaggctgaggcaggcagatcacctgaggtcaggagttcaagaccagcccagccaacatggtgaaacctcatctctactaaaaaataccacaaaattagccaggcgtggtggcacatgcctgtagtcccagctactcgggaggctgaggcaggagaatcatttgaacctgggaggtggaggttgcagtgagccgagatcacacaactgcactccaaccagtgtgagtgggactccctctcaaaaaaaaaaaaaaaaattccatatgaaattaaaaattttaatatctttcctggattatagggtttccactgagaattctgctgccacatattctaaagcttcattgtatgttatttctttctttctcctgctgcttttaggatccttttttatccttgatctttggtagtttgattgttaaatgtcttgaggtaggcttctttaggctaaatctgcttggcatgctgtaactttctttaattgactattgatatctttctctagattttgaaagctctctgttattatccctttaaataaactttctaccccatttctctctctacttcctttttaaggcaaataactcttggatatgcccctttgagactattttctagatttggtagatgtgcttcattctttttgcttttgttttctctgaccttgtattttgtaatagcctgtcttcaggctcactaattctgtcatctgcttgccctattctgcttttgagagagtctgatgcattcttgaatatgtcagttgaatttttcagccttagaatttcttcttgatttttaaaaatgatttcaatcttttcgttaaatttatctgataggattctgaatttcttctttgtattttcttgaattttgtcaagcttccttaaaacagcaattttgaattctctgtctgaaatgtcacatatctctgtcactctgggattggccactggtgccttatttggtttgttttgtgaggtcatctttcctgaatggtcttgatgcttgaggatattcgtcaatgtctaggcattgaagagttgggtattttttgtagtctttgcagcctaggcttctttgtacccattcttctaggaaaggcttttcatgtattcaaatggaatagagtgctgtgatctaagtttttttgtcactgcaaccttatcagcattaggggacacaccaagcccagtaacactgacttgcagattcacagaggtagtgccttggtggtcttgggtaaaacctgagagaattctctggattaccaggcagagattcctgttttcttctcttactttccctcaaacaaatgaggtcattctcctctgtgctgagctgccttcagctgagggaggtgctaccaccattggaactgctctggttcagacttagagccagcatagcactgggtctctctcaaggcccacagcaaccattgcctggctcccacctatgttcattcaaggcccaagggctcttcattcagcatgtggaaatccagccaggcgtgtgtccttctctttattgatgtgagctcccttcagcccagggagagtccagaaatgccatgcacaagccatggcctggagtcagaaacattaggaatctacttgatgctccattttactgcagttgagctggtagcaaagccacaatacaatgttttttctactcctctctttcctcaagtaggagtctctccctgtgtccaccatagttatcaatgttctgggttacaccagaagccagtactgtatgcgggtctcacccaagtcccatggcaagtactgcctagctatctctgatgtttattcaggacccaagggctctttattcagcagaacttgggttctcaccactgggatggatgactcccctctggctagggctggtataaatgctccctccgtgggttcaggctgaattctgccatgttgctttccactctgacagacagcatcaagttctaatgcgaagtctcacaatcactgtactctttcaaacacatagattcttcataccacgtggctgctgctgggagatgagagaggggtaacgtaggcttcaagactgtctttcctaccctcttcagtacctctttcattaatatgatgtcaaaacaaggtactgtgattactcacctgattttgttttttctggaggtgctttcttgtgtggatagttgttcaatttgatgttcgtgtgggggaaacaaatgttggagggttctatttggtcatcttgttccccctccctaagctcctctgtagattttgaataccaatactcgtgagcttgttacacatcagtaagtaagaggtgtagaagaaaggaaatagcagaaaagacacttgagattctcagtcaggattgcgcttttagaaccaactctctgctctgagcctttatgttgtgagacgataaaaatgtaatatttaaattcatgctaagccgaagtgccagaatattaactaaatgcaggtgatgttatcttcctcccacaatactattattttaactgatcttaaacataaatggaaacacagctccagctagcacatttcctatatttaagccaccccatcatgaaaaaataaataggttcatgtaggaattggtaaagttccacagcttgaggcagaaattactgtttggtagcctatctgatcagttatttagacacattcgtaaacagatcagattattgatccatagaactaattgattcaagaaaacggcatttagtgaaattgaaatatcagaatttatgtcctgtctcagaatcactgggccaaaaaacataacccaggctttagtattaaaagattggagcagcaagaatttgttatgcatccactctgtgcctgaggctctgctgagcactgtagacacaggcagagtcatatactacagacagaatgttaagggtttataatccaggggatttaagttaaataccccagaatctatttcactctaaaactgaatgctaacatgcccttagtgcttttttcatgtaactcagaatgatccttgtccttaacttgggtaagtccgaagtttgacattcaggctactggtattttctcatcacttgacaatacataaagaagttaaacaaagagagtaatcagttttctgctttttgtttctcaaagttcaattttcattgccctctatagctgaagatatacagttttctaagttgtgagaaacaaatcctgtttatctatgattttccttaattcaaatacatctgtgtttagttgaaaaaaatgtgtatatgtgtgtgtgtgttttgtcttgctcttttacttatcccttcttcttgtccccagccctctgcaccagacttatttgaaaacatttttcctgggggaaaaatatgtctttagaaaagtacaaaatgcccaaaggtaggatacatttaatatgaaagaaataattattagctaacttaaatacctaatttccaagttggcttactatattggcccacatagaaagagacacctcttctgattaaagcaagcaagaccatttggtactatcttcttggcttctaatcatcctctttatagagtgatactactgacagtgggatattatacatatgaagtgtattagtcaggttctctagagggacagaactaataggatacatgtatatatgaaagggagtttattaaggagaattgactcacatgatcacaaggtaaagtcccacgataggccatctgcaagtcgaggagcaaggaattcagtggtgaatcagcgcgagtaccaaaacctcaaaagtaaggaagcctacagtgcagtcttcagtctgtggcccaagagcccctgggaaaccactggtgtaagttcaagagtcccaaagctgaaggacttggagtctaatgttcaagggcaggaagcatccagcttgggagacagatgaagaccagaagactcagcaagtctgctcttccatcttctcctgcttgctttattctagccttgtgggcagctgattagattgtgctcacccagcttgagggagggtctgtctccctctgtccactgactcaaatgttaatctcctttggcaacaccctcaaagacatatccaggaacaatactttgcatctttcaatccaatcaagttgacactcaaccttaaccatcacatgaagtatgtttgtaaataaaaatgaactctgtatcatgataatccaaggtgaaatggacatttacttttctggcaagtctgggtgttttctgcttggaaagcaatggcactaggttgcatatacagcctctaacaagcaagctcctgaaatatgatttctcattgagcaaaatggttattccacacataactgcagtttcagcagtgcctttttgtttctggttattaatttctatttaagttgtgccaaagtcattaatttactgagccaacatggaaaatgtaaggcagttaactttataaatgacaccatcatgcttcagtatatttgtgcttaatgccattataccacgtgaaagattctaatttccttatacttgatgtaactggtggtattagaatgctaagactgtggtagtgtttgttgctttaattgtactgaactgactagatacaagtagcccgttaagtcctcattgtccaatctgaaaactacattattgttaatttttttcttttggaagcatcaagctttctcaatattgtgacacttacattactgttgaagtctttaaggagagaataaatatgctaataacattctagaagcaactaactctaagcaaaagtgaatagtacagcactatcaaggtgtacacttttttccctggaaaattatctccatcaggtaatgggaaagcactgctctacagaaaagcaaaaaatgacttataagcttgattcattgttactttaaaacccttcatatctgaaggttaagctaacattaaggcagtgtacaactatcagaacaatatttcatatatttgtatttagatgaatcaccagatttgttagtctctgaatattttctatattgagccagattttagctgccatttttgtgttttaataaggttttcagttgttatccaaatatgacccagtacctgaatcaaaacagcaagctttgaggaataggtcagtatttttggataaactaacaaaaaaaatgttcatcaggctaagacatcagcagtatttgtggtagaattaatgagtattgttagtgtatattttaactgttaatagtcaatgctctattttttctatgaaaattcaacttcctagtcgactctttgcactccttcattcacttattattttacggatttccctcttgtgtcagatctctagaaattctcacttttcatctggttttacaatcattttctatttttctcagctctagaaaagtctctaaacaactccagggcagaggatccatttgtttaacagtggcttcttgatcaataattgcatgcatgaaacaaagtatcagaaatagtttgctctttacactatcaattggctgatatttaaacaaattgtctttaaagtcactgccgcaattttgtttggcaatggcattttatttaattcatttattaaatgagtttccaaaaattaagacctgaataatttatgacttcttctaatctcaacagaaataagtcaatgctggctgggtgcagtgactcacatctttagtcccaggtacttaggagggtaaggctagatgatcgcttgagcccaggagttgaagactgcagtgaactctgattactatttcactccagcctgggcaacggaaggagaccccgtctcaaaaaaataaaaataaaaagtaaaagaaaagagaaagaaataaaacaatgttaatctgtgtcttggcacgaagtttcacacttccatcaaatgggcatcattttgtgctgctaatgtctcttagggcgattttaaaacaaactaaaaatatgaaacactggatagtgttagccttacctagcttgattttctttgggtgtacatgaatgcaaataaattctacaatttcttaaattcatatatatgtatatatgcacatacatatattcatatatatgtttatgtgtgtgtatatacatgtataggtatggtgagtacatatggggaaccagttgaaggatgtttcttcttttacaagaaaggagagaaaacaatcttcccgaaaagtggtatttactagcatgaaaaaggattgagcttcatataggtagacattactgtatttctatcatagggttatgtgtgtacataatccaatctgtgtttataattcacatacctactctccattattttgatgattcaggaaagtaatttctcaaaatttttccttttgcaaatgtgctttttagataactcactggacctaaacacttggcaggcattagggtcgaccttccctgctgggttgaagaggctctttcatcccccagacctgcagactgaaagtcagccaaagtgctagagattctggcccttatgtacctgctgcctatggacttgagttttacagaaagaaagcattacttggcaaaaacctgctgatcatgtctttccccttggaacctcacagcacaaggcccaggcttactttttgattcagtgatggtgaattgatggactattatagaacttttcacttctgtgaagcagcattgtagtatcagcaccctgcatttctcttaaaataaaaaaaaaatcacagtgattctaggttttaaaaagttgtattattctgccaaaccatcataaaatgctgaatctttctagtcaattttattgcaaataactactgctaaaataaagtagaattaggtaagtaacttttttgataagcatttacattcttaagatgtgctactgttcagtatgtgtgaactcctaagttgccagtacagtgggtgctattgctatactaacgcatttcacctgtcctttacctcctcttccagaggtgcatactacgtgaagttttccaattgctgctgctttatttgcatttagtcacccagccaaaggttctcacattttatgatgctttataaaaagcttcaagagcatattttaaaagcaccctgtcagaccccatgaatacacactctgaatcaattgttacagattgaggccaacaaatattcattttttcaagctttcctggtagctcttactaattcatccaagaacatcttgttgaggaatacacaaaagattttgactgcaggattaacctatttataccaaagctttgtattcctggaatggagcagttgcaaatgctgatgactattgcattaattgatgctttgagatgtagcagtactcaacctgttctctaacatctgacactctgtgggaaaacaaaccaacaaacaaacagcaagaaggagtggttgaaatagcaaatagtcaacctggacagtatctggcctcccaagggaggcagaagtagtcctgagggatcctggggtcaaaatgtggttgtgaaacccagagaggggataagggctgggtgttcagtaggaacagtgggaacacgtgcttctggttgctgtttccttttcacttatcagtttacacgtttctaagcttagagtggggtatcgagaagcagggtctcattgggcatgtattatgctgagctcagctgacttcaggaaacatagcaaagcattataaactgtaaggaagaagacagttacgatagaaaattttatgacaacgtaatgtatctctcatggaagagctgggggatgtcctagtataagaggttctagagtcagcaataagatgtgagagtcctctctctctctctcgctctttttttttttttttttttgagacagagcaagactctatctatctccaggctggaatgcagtggtgcaatcatggctcactgcagcctcaaccttctcccacctcagcctcccaagtagctgagactatgggtgtgtgccaccacacctggctaagtttttttttttttttttttggtttctggtagagacagagtctcactatatttcccaggctgatctggaactcctgggctcaagcgatcctcctgccttggcctctgaaagtgctgggattacagacctgagccactgtgcccagccaagattttcttttttaataacacaaagaccaagaggctccccaaacagaaaagtgatgaatgatatgaacttagtgctaggttccagttcaagaatgcagactgatgctgaaatgatggcacagattgaaaggccaaggacagtttctggcatcaaagcctagggcaaggagttcaggaggcagggggcggagactaaatgcacataagttgaggataataagatgacacagggcagtcactcagaattcagtataccactaatgtgcatgttttgaatgcctcaagtcaggccaaaactattagccttattgagcatgattaggtgtgctgcttttcagacagttactgcaattacatactgtgcagttcagttcagtggttggtatagttaagcaagggggtgcctgtattgaaagattgtggactaggtttgcctgtatttcttgtttaaaagttgattctactgttacatttgttctaaacagttgcatcagtttatattagcagttgatcatctcttgcccattgaaatcaatgtgatttagaagcaagatatagaatctggagttaggtagtcctggggccttcatttaccacccttagtttattgtctgtataaatgtgataaattatgtttaccttataagtgttaaatgagtgagcatgtgtggatatgtggctgggcgcagtggcttacgcctgttatcccagcactttgagagtctcaggcaggcagattgtttcagcccaagaattcgagattggcctgggcaacatggcaaaatcctgtttctataaaaagtacaaaaattagcagggcatggtggtgcacacccgtagtcccagttactcaagagtctgaggtaggagaatcgctggagcctgggaggtcaaggctgcagtgagctgtgattgtgctactgcattccagcctgggcatcagagtgagactttgtcttaaaaaaaaaaaaaagaaaagaaaaaaaaaagaaaaaaaagaaagggcatttacttggaagcattcttggtattcagtaaatattcactgctttctccctttactatttaatattctctggcttcataaaatttgactcttatgacttctgtgctcttattcacgtgaggcttctatttaattatcttgtcaactactatgtggttgatttaaggtatgtgaaacaagcattcatctgttccacatcatgtttctccctgggaccacatctatcttatattaagtgatctttgaagcagctctaataggaattggtcccttgggacaggaaaacacctgctcctgctctctcttgtgctcgcacgtcccaggagtcctgacctgtgtattatcataggcaacaccacccaggacacctggccatcttccattcatggcctcccctttggtgaagaatgtcctcaatatttgtggcaattagcagctattcttgggtaacctttagttaaaagagagtagtctcatgggctaaagactaaaaagaagacgtgtaataaaattccagagaaacaagtcaactctgtcagtgtttatgtgaaaagagatctgggagatcagtgctcagccttccccaacagatgcacaatgttttgtagcagggaattggaaaacaaactttgacttgggattcattgtgtgactcttcattccaccaccaacaatctgtgtgacttcaagcaaaacagctactcctgaacttctgtttcctcctgtataaaaaggggatactgaagcatctaatggtttgttggaaggaatgaactgaagatcagttgtaatgctctaagacaaagctggcttatgataaatgctagtctcattctccttgttgtcttttgagaattgccctttgtttcttttatgaaaataacatttccatctttcccatcccactttttcttttaaaactgcttccctgtacacatggggcagccacccaatagctcctgaagggatatacatgtatctctttaaaggggatgcagctgtctgcattgtttgcattgcttgcacagtggtgggcactggtgtcataacccattgccatagctaagcctttctctttggtatggctggctgtgtgcatgcactagaactcggtatggtgtatttccccagagctcagtcaacaaggaattgctaaaatgaaatgccatttctgctgactgtaaatggaagaccctattttctttcataaatgtgtgaaaattcaaataattaccctactatttgatgtccaagttggtaaagatcaactagcagtaagtcccagcatttagttataacatatttgacttttgctttgagcccaagaatcttcaacatacttggctgtaaaatgggaatatcaaagctcatgtgttctcacatgatttttatggaaagcaaatgtataatgtacctgacaaggagacataggtatttgtgtgatggcctcaacatcatattaaaaccaccagtgattttcttattgatatgttaatctcttatcacatgggaacttttttctttgatggtcagtttgctttcatcttgaaagaaatcaattgttgatgtacgctgtgtgttaattgcttcgttaatactgctctggtacaataaccaactgtagctgaaataatttggcatgttcagtactgttcacgttggatagtaagtattgtgtggttaaaatgaagatatctatggcaaacttgcaacaatcccaaaacattgcttttctggttatatatccagaggcagttttttttttcccatattcattagtggtcatcgctctccacaggccattgcaatagataagtaggtagtaaccagggtaaagaattaggttgcctagaaggtcagtgaaccatacagaacttgcatatgactagctgatgcctagttgttgaggtgaacattgtgataaaatcatatttgctgggagtggctgacagaaaatattttgtgagtgagttaaacacctcacatcttgacataaggcatgtatcaagctgtttatgacagcatctgattcagaaaaagtacttttttcagtattaaccatccaatgcaaatatttaaagcctgcttttgtttctatcaaagagaatgttgggacagagattgtaaaagagaatagagcctgcatattttcagatcctactgaaatacagctaaacttagattgtttatagagaattgcacatttcaatattttagtatttgtcttactccaaatgtcgtttgggttgtctgggattttatccttggaatatattgcaagtgatctctgtgttattcgcctcagctcctgaattctgatttatcgtctctagtaagcaagccagtgagcatcacacaggagattctcagggctcagtcattcaagaagtgtggactgttgaaatttaggctttgtgtacaatctgggtaacaaaccgtaaaggcatgttttcttcctaaagctctatggaaaagtcatttgccatattacttcccccaacagcgtgcaccctgatgtggagagatgcagagtgtggtccaataataatattgaccatatgcttttctaaggcaagcagacatacagtagatactttaattttggtcgttggggtatggaaggaggtgggaagtggagaaaggagagtaacccattacctgtctggcctaagcttgttatgatctgacagatgggtagccccagggctgcttgcaaaaactatttctttttgtctccatcacagagccctggggtgtggtacagggagggttgaccaagagaggggaggcttccctgatggagtgtgaggtctggcagcaggacctgacaaaagtgagtagactgtctgggtccagccagctataaaaggaaagaacagaataacagctacagctcggtgggagttctagtacctggattttcacccaggtggatgccaggcctgattgtctatctcctgaggaatttccagactttgtcagagttcttcaggaactgaccagatccagtttgcaggttgggggtcatcactatttccattgggtcaaattggagtaagcagataccaagagtcacttacaaatcactaacatctattagatactgaccattctctcattttctcacatcaaccatgtgagataggtattattattgttcctgttttatagatgcagaatctgtgatttgtctggaaccacagctataagtggtgcagcttggatttgatctcacatttgattttccctgtgatccctgggatctggcttaggtttggatatgcctctgaacaaatggtaaacaagggaacctaaatgtccataggtgtctatttacctggttgtccttagttcagcatctttaaaatacaaaaatagatttgttgagaatactcatttccattattttaatgagaataacaactcagctaacttttaacatgaatatacactaaaaccaaaagtattatgctgatggcaatctctacttccttcttattaaagcttatgagccatggaggaccctgcccagcctgagctgcccaatgtgcctgcgttagccagcctcagtgtgtccctttgtaaagcgccccagaccttttgagtagggatgaccacttcttaattcatggtatttatcagtaatcatgcatatgcaaaattttcaacttctgcttagagcctttactaatttatttctgtgaatgctctgattccttccaaatgactctgtaagatgatggttgcaggcttcattagttcaaccttcagaatcactcaatgttacagtcccagttttctctctcttttacccaaataggctttacctatattaatgattgttgctgggctcttcgacaagatatttcaagaatgggaaaagcgttttaaaagaagtttcatgaggctttggaattcacaagctgtgagcagcactggcagatatttttccagggtgttcatttttattcatttccttatagcttttatggctaaccgttctaagacatatacagtgctgtgttgtgatcaaattttctcctctgatagaagtcaaactttgaaaacttagattcctagaattgttgaacattctaatcaaaaacttctttgagtcaatccagtttaaaatatcactgattgcgggggggtggctcacacttgcaatcccagcactttgggaggccgaggtgggaggactgcttgagcccaggagttcaagaccagcctgggcaacatagcaagaccccatttctaaaacaaacaagcaaataataataaaatatcactcatattttagttctttctaacccatggttgatactctcaaccacagagtgaggaacttactttctgcctaccatttaatctttgatctctaaaggtttggaccaaatggcttttttgccgtaagcttaaatatcttgtcttatttttttttcctacctatttgtccaggttgttttctttgcatttaggacagtggttctccatacgtgtgcatcaaaatcacctggagtataaaatacagattcctggggctggctgtggaatctctgatttggcagggtttagggagaggcctgaaactgcatttttaacatgttcctgggtcgtattgatgatactgattctcaccttgggaatcactgacctaggaaatgtcttctcttcatccaaagaaacccttacaatccccaaagatgcctttttttctcctggctgaacaaccccaatttctatgactttcctttttagacttcagcttctccaccatctcaccatccacacttcttgcttgcctgtcctgcttgcctatcactcactgaatttcagggagccaaactggcaatataaatgagtgaaccaccacaggtgggggtgagatgagtcagatagggaagacagcagagactgtctacccggaatcaactgaggaatgcagacctcacccaaacaattcacattcctgtttttttgtttttgtttttgtttttgttttttttttaagcatcaagcctacctaataaaatatgaattataaaaaataattcagttgcctagatttgaccccaatgaatgatagtttgaggtcttaaaatataattaaaatgcagcttgaacctgaaagtggcagactatcaagttattatccccagttgtttgggtttctattacatgaatccagttataaaaataacacttaatacattataaattcctaattagggagctacccagtaactgattatattgacaaagtcatgccataaataagaattaaaaagttaatataattgattagctaggatgccctcactcttgtttttgccattatttaaaatttaattgctttgcaacatttccagatgttgattttggacattttttcatgtgttttattgcctgtgagcagtttttatgtacttgtaatcggagcttttcacgtttcttggatgtagaaaaatcaattaaaatgaagcaaatatttttgaaacctaaccagacttttgtctttgttttctcataaagttcctccatagaaatgtgtggcatgggaacagagcctaatactttctgaataagatattaacaggcttgtagtggatgctgggaatttagaaagctctgttttttttttttttctaaagcctcccagtagaatgtcagactaataaatggactgcatatttccacagtgtttttatgacatgtttcacacactgtcttggtgcagatatgagaaagcccttgtccacagcccagttctgactcactcattaattttaccttgtattcagttttcttggggtggatctagactagaatagaatagaataagccgacctttaactacagtccttaaatgaggaaatctccaccctgggccagctgtgccaggaatcccgacgagatggaactccgctgtggtttataggcagggctgattttcaggggggagtgcacccatctggactccctgctgttcccatcaatctattccagccctggtacccctggaccaccctactgtccagcaactaaaggattaacaggagccacctccaggagcctccgggacccttcagaaggtgtctgatttgatggatcagaggctaggccactgccagctctctgcacatattttacatatcacccatttgcaggtgttgaagaccggtaagtgcccaggagctggcaggtgttgcaaacatgtcagtgtacctggtgggggcgctcctgcccagctgataggagacagcttctacccagcccacccctttggtggctacaccagcttggcacagtctctcattgctgaagagcatccccccgccaactccgcccaatccccacctccagtcttgactacttttcattggtttgtttgtttaaattgacatctcctgattttcaaaaccttgctgattaacaaagcaaaaagagcacacacaaaaaaaaaaaaaaaaaaaaaaaagtcaaaaacaaagcaaaaaactctcagtctaaaacagataaacaaaccaacaaacaaagcccaggggctgctagaggttgactcttgtaaactgcaagaacggacaccacaaactccagagcagagggcgcctggacattccagtgacttcatcaagcagtaaaatatccgtctttcatctgcttctgctgatgaccaatactatgcctgtcacaatttccagtcttttagagctactctttgattacacacaaccgagactttttctaagcctaggacattttctgtgtccttttaaacattgtttacatcaaaataatgatatggataggtaaaagaaaaatacaaaactacttgtgctgtaaagtagttctattttagaaaaggaaatcttgacaaaacttgagccttgttaggaaaaaagaaaaatgacaaagcagtcatgtacagaaagcctggataggattttcaatctccttgtgcaaaatctggcaaaaatgtatgctaagggtccaaagcaggaagtgctcagaaagcaaatacagaaactcagcttagcaaaggggcgaagccagagagggatataaaggaacagaggaacggctgaggatagaggtgaggaagctggactcacacagactgggtcttgctcagccttctgcagtaccagtgtcagggccaggcacacaggagtgactaggagtttgaactgaaataatgcatgactaagaattaatttgggatggtcttcaggtggaatgattggaaatgttgttttacttttaatttttcagtacatgaaagaaaagatgcctgttttctaatcattgaaatcttattatgtacagaaattttcctagcagagcacacgaggatgaaaaagaatcagatgggagatgaggatcaggactctttctgtgaatcggaacctctctgctctgctccttttctggtttcctctgtctgtccttctcttgtctccattattcatcctgtttctgccttgatgtcatcttgttggatgtcccatctcacttagtcgtctgtaatttgtaagtagcatttaaattatttgtggtctttatctaataaagctttattctctctggtcttgatgaatgaagaaggcaaactgagccttgttttttcccttattgtcttacttccccaaagcacctgaatgagttctgtgtggtctttattgacctgtgatgatcactgtcccataaaaaaagcatggtagcgtagtgcttcagcataggctctgctcagaagacttggatcccaatccttactcacttgtcgagggagtttgaacaaataagtgaatttctattgacctcactctttcacatatgtataaggggaattgtaatagtacatgtttttttaggtcattaagaggattaaatagatagaatataaaatacgttagcataagtgcctgggacagggagaatactcagctaagttggaaatcaggtgttggcaaactttttctgtaaaaggcaagaaactaaatattttaggctttgtgagtcaaagtctctgtcttaactccttaactctgccattgtaccgtgaaagcagccacagacatatgtaaatgagtgagtgtgggtctgttccagttaaaccgtatttacaaaaagggacagcaaataagatttggctcatgtctctcagtttggcgatcctattgtagaatatagttttgacatactggaaacagcttctctgtaagttaggatctgctttgttgctaactaatttaatgtgaaatttaattgacctatccatatgctacatctgacaaatagtttggcacacaatttgcttagcctttgtatctcgaggaccagagaagttaagtacgtttggccaaaagtcacccagcaaattgatgacagatctggggcagagttcagggctcgtgttctcagttctgaactatttctttttttttgaaatgtgtgttatcggggacgtagctctgtgatatcaagagactgggactgaagatctagttttgccagttgcggaacctcagatttgtaccactcactatatttggacctcagctccctcattgtcaaatagataataattcccatctcacaattttacagtgtgaaaacaagaaaatgccatatatggaaaatgccatatatttgaaatctctattgctgtggttggccagcttccttcctgccttccttcttctccttctccttcttcttcccccaccctcccctctctctctctttttctttctctttctctttttctttctttctttcttttctttctttttcttttctttctttttcttccttttctttcttctttctcctttttcttttattacttaattaacaaataataattgcatgtattaatggggtacaatgtgatactttgatacacacacgcgcacacacacattgtagaaagattaaaccaatttagttaacatttatcaccttatctacttataattattttggggatgagaacttttaaaatctactcttttagcaattttagctatgtaatatatttttatcagctatggtcaccatgctatgttacaacttattcctactgtttagctgaaactttttaccttttggtcaacattgcacctttccccattctccctatcaacctctgataaacaccactgtactctctgcttctatgagtttgacttttttagattctacatgtaagtgaaatcatacagtatttgtctctgtacttagtttattttacttaacataatgtctttcagtttcatccatgttgtcacaaatgacagaatttcttttttgtgtaaggctatatagtattccattgtgtgtgtgtgtgtgtgtgtgtgtgtgtgttttctttatcctttgatcatttggtgggcaattacattgcttttataccttggctaatgtgtataatgctgaaatgaattatgagtgcaggtatctctttgacttacttattttaattcctttgggcatatactccgtagatggattgctggatcatatgataattctgtgtaatttggggcgggggaaccactacactgttttccatagtggctacactaatttacatttctatcaacagtgtacaagggttcccttttctctgcctccttgccatcacttattatctttcgtacttttgatattagctatcctacaggtatgaggtaatatctcatgttggttttaatttgtatttccctgacaattagagatggtgaacttttttttcatatatctgttggccatttgtatgtcttcttttaataaatatctattcaggatctttattcactttttgatttggttatttcttttttttaacattcagttgtttgagttccttatatatgatggatattagccccttatcagatgtatggtttgcctatattttctcccaatcaggagggtgtctcttcactcacttcgttcttaattgttttctttgctatgcaaaaagtttttagtttggtgcaatcccatttgtctgtttttgcttttgttgcctatgcttttggggtcctatccaagaaatcgttgcccacaccaatgttgtgaagctttttctctacattttcttctagtcattttaaatttcaggccttatatttaagtctttaattcactttgagttgatttttgtgtatggtataagacaagggtacaatttcattcctctgcatatggatatccagttttgtcagcaccatttattgaagagactgtgctttccccattgtatattcttggcacctttgtcaaaaatcaattgactataaatgtgtgggtttatttcagggctctctgttctgttccattggattatatttctctttttatgccagtaccatgatgtgtgtgctattatagctttgtaatatattttgaaatcaggagtgtaatgctgttttgctttttttgctcaagattgctttggctatttggggttttttttttgtttcatataaattttagaattgttttgtctatttctgtgaaaaatgccattggaattttgatagagattgcattgaatctgtagattgctttgggtagtttggacatgtaaatgatattaattcttctaatccataagcacgggatttctttctgtttgtacatgttgcctttaatttattttatcaattttttttggttttcacttcctcaattaaatttattcataagttttctttttgaaatactattgtaaattggattgctttcttaatttcttgtttgtatagtttattgttagtgttataggaaatgtactgatttttgtatgttgattttgtaacctacaactttattgaattcttttatccattctaacaactttaggtgaacactttagggtttcttctatataagatcatcagcaaacggagacaatttcacttctcttttttatttcaatgctttttattgtctataaatttattgactgctctttaatctttcacctactttgtaagataaatttagtgaaacaggttagacagcatggaggactctgatacaaaacgattttataaaaacacacagatataaatgttttctgattaatggccattagctagtttcccaatcagagcacgttttcacctgtgctctttaaattgctttcaatgtagagttacaaaatggaaacttaagggtcagaaaaggtcaaattacattaatgacagtcctcatgatagtgttgatttaatcaggatgcctacctttgttcatttaccttttaaaaataagtataatatattgcagatcactaatactgctgttagagaaggtggttattgtattaatgggatatcagtaaccttctctctactgtgacatggattactgtaattatgaaagagacataaggaaacaccataagcactatccattgggccccaggcttcattagttctcatatggctgtgtaaaaatgctaattacaaacatatcgtaataaaaagggtatggcttaatgccaacatgtacctgctaatttgatatttatgatggtagagtgaagcacatataatcaaaagcaaagagacttcagtagagcagcattctgtattttgctgactgaagaaggctgtgagattatccagccatttatttaattaaaataatattgactggtgaccatgttattttatttagtagatgtgtaagcatattcatttaattttcaatatttatatttcatgtgattataaaaatgataaaagctcaatacataacaggtagtatggacatgtacagaaaacaaaggtagcagaatcctctaaactttagctgcttcctggtctacatttatatgcacctttctcactagaaaacatatcgattattttctgaattgtaattgttcaatttaaaaataattttaaataaggaaatgttggggaactgatatagctcagtgttgaggcagagatgttcctctgttcatatgttttggccatttttatgtgaagctgtagagaacagtgactagggtacttgtgctaacattgtcctccttattaaattggacatacatcatattttagggcaaaatttcactttctgatttctcagaaagcaaaagcgatatcaaaaagtatatcaatctacacttacatagattgattataacattttcatttattttttttttcacaaacactcattgtgttctgtctgtctttggaatgagatatacctgaatttcagtctcagctttgctccttaacaactggaaggtatgtccatgtaacatgatcccccaggcctcaacttcctcatccaaaatctatagattaaaatttgtcttctcaggtattgtgagccttttgtgagatcatctttatgaagttcctggcaagaacaggtactctgaaactgttagccagcataatgtcaatatcacctcctattattagtgccatggtattttgtgaagtgtcttattaacataaatatacatgggtaaacattttcacaaggatgtctgtaaaaaaaagaaatttctagtgaatttccagaattggaaaattgtggaatttatccttcatcagattttagctccaatggtgtctacctgccagagtgctttgaaggaagatccatggagtttaagataaagttagcttgttttacagtacctgttacttttataggtttttttacattttaatagctattaataatataggtatgattatcagcatgaagctcccatacaaataagtttatgttgaaagtgtcaatcgtcattaatatcccataagaagaaactatttaaaacttcataggagttcatacatggggttcccatggcaacaatggagcttataatttttaatttattgcttaattttctctaaactacattgtcattgcatcggcaggaatcccagtctgtagtaatgatggggattaaatggtcattatgaagttgttcaacattcttgtgatttgcttcagggaacattggctttgggtatctttgaatgtactattaagcattgttaaatccatttaaaatagactgagtttacagggaaatgaagtatattttcttattgcaatttatcatccagtaataatggtaaatattgcaagtcaaaatttaaggccaaatgtaactcaacagtgagctgactaatggctgtcttgtgcttaaagaaagtatattgcttttgcatttaaccaaatggtcattgaaaagtataaaaagatatttaatagctacaagtcatattccagaaggattcaatctgtaatataaaatgagccaaaggaatcggttgctgtcttgttaaagaagataatcattacctgagattttatttttcttataagtatctcctcctatgtcaaggtcaaactgatagcaggttagaggtttgtgtctatggacatctattttgcaaaatacagctattcataaactaatcctgaaatcatttaaaatattgcaggatcaattcaacatacctatacagtgtcaattcagggaggtcaggaaagtctgtaagggagaaatggaatattagctgggaagcatggggagaatccaaacagaagggaggcagggaataggcagaagaatgacagacatgaataccattggcagaatgtttgtggtgttattgtaagttaaaatgttaagggagaaggaggcatagaaatttgctttccaggtgggaaatttgatcaagagtctatcttttaggaaacagacaagatggaatatagatcttccagcttgtagtatgtttcaagtgttttaagaatacaacccaaacattatcaagtgatgttttaggcaaaggagaaagtaatgtgcatgatactgaatgttcctgtgagcatcaaggaacgtgattagcatcgggagccctgtgaaattgtctaggtcactcacatacctttgtgttcctttaggattattacaaaaaacactcctatcaaggtagtttagaaaacatgatctccatttaatagaaaggggatattttgtttttctagagtggtaactgaaccttgataaggaaaatatgcagaaatgagtgaaaaatggggccaagttgttgactacattgaataaaatgttagtcaacatcaaagtccttttatgaaggaaactgaattaacatgtcatttattcattgttacaaataattttcagttaaacaagtgaatattttctccaaaatggctctaaatttaattgtcatctaaatgtttgaatattttggcttttttagtctcctgtgaacatgtctgttggtctatggtgtctcacggtgtatgtgctcctgtgagcatgtctgtgtgtatgtctatgtctgtgtctccgtatgtgttgtatttgaaagtctaaaataggaggccctttaagagaagtgtttatgatgttaaaatctcaagtcttttcatggaagtgtgtctgcgcaggtaaattggatgtatatttctctctgaatgatctgactgttgggtttaataaggctatagctgatgccagttgtgttgaggagtttgcaaatttattgtcaaataaactctcctcttacactgttttgagatcattcctttgggcttatgtactttttcttcacatgtaagtaaaatgccacaaatgcttactcttgaaatcctgagagaagtggcatattatttttatgggaattgtacgattcttaaccactgtccttgattaaaataagagccttttttccttcttaaacctgatcattttcacactggaaatgaaatctttcatggggattagtttactcactcaagctttccattcagatgaaggtgtgaaaaatacatgacaagaatattatttaaatgctcaaacttctgcatgaagagcatgaaacaagaagaaaatgatagtctttagctgtagataggtttcaattttttttagtaggcttcaaattccttttaagacaaacaaaaaattaaaatagaagaccaactatgaaaataatgatttgatttaatctaaacttccatgaaggctgcaagttacagattaggtgcatcacctgaaagtaacattgctgattgcatagctttggaagctaggttcaatgatgtatatgcaagtaactaagtttcatatgcaatggttctctattgcactcaggaaattagcctggcatttaaagccattcatcatccaacctcctgaccactccaacactatcttccttcactctctcagcactccaaatatctctaactgcttgcagtttcctgaatatattactggttttcaagtctctaaaaatgttgctttccctgtctgtcatgttccttttctgttgttccatctattggactcatcctttaggatttcattccggaatcagtttccttctccaacatcttcctttgggttacctgggtggctaacgccctctgttctctcatagtaccctgggttcactccagtcatagttctttatacagaatattttaagcatgtttatttttctgcttctcttattaagtagagagaatctaagaaatagaaaccatgccttcgttagttttttagtcccatagcatcaggcttcatccctggaacatagtaggtgctcagtcaactttgttgagatagactttgtgagatgcagcagaatcaaggaaggtaaatgtcctgggttctatacagagggagttaaaaatacaaataagaagaagtcactcttctaaaggaacttgaaaaggaaaagatgcataattatcttaaatataaagctatgtgtggatgctgtcagatgttcacctggaaagagtcctggaatgaatggagcaaaaaattcaaatttcttttcactgagaggtggtggaaagccttcatgaataaagaaacatcttgagctgagcctcaaggatcctataagagttgtttattgtttgtttgtttgttttagtggatatttactgagctcacatagcctgtaagaatttaagctctgtattaccactatggttgacaagtgtgaatttaattagcccttttcaaaaaaataataaaaagcaatccattttacctacctaaacacaatagaatcatctaaatatcttattttcagtggttttctgatagaagataatgcacttattctgaagtcctgtcccctagcaacactcttcttcaccagtctgctaatggcttggcagaagaggtaaactcagttttggggcaaaagttttttaagcaggaaatcatgcaaaagtataaacagcaaacagattttaaattctgaaggttcctgggaaaagtcataggatactgaatgctttgtcatggctatacagatgaaaacatcgctaaacagagtgaatcataataatggattttgtaaggaatttctttttttttgttttgttttgttttgtttttgagacagagtcttgctctgttgcccaggctagagtgcagtggtgcaatggaatttttaaggcatagttctctgtttgcttttaacccaagcaagaagaagaaataggactgtaagagagacaagaaccctatcaatttgaataactcagggaatagcaaagtatttgactttgaatgcaggatttctctaaaacattgaatattgaagagaatattttaaggataaagaccaacattcagttagttcttgctcagtaaatgtggtagtagggaaacaagttcagcatgtgatctaagtactggcacatgaatgaacagcaaggctcataaacagccaatgagaaaatgaagctcactgttaatatgggaaatataaactagaataaaattatattggaaaaattttaaaaatatgtacaatacctggagccctgggggtatggaaaatgtgtactataatacactgttagcgaggttagacgttggtgaagtctttctgtcttgagacaaagtgaattggcatgctatttcctgagagaggaagactgggaaagaacaaggtatagggaagtattaaaaaactaagaattctatttgggaaattttaaaagattattatcaagaattcaggtggggatgtcaaataagccattgagcctggagccccaggaagtggttagtgctggaagaattggagtcaccggcatagagaaagtacatgaagttatgggactttagttatcaatcactagtttcataactagaggttggttaatggtctgctattgcagggtgcactgttctcagaatttgtgtggatatgataacacaagtcctgagttccaactttaaggagcatgaaatcttgttttaaatacagaagcaccgactatggggcaagtggtccattaaatatataaagcaatcacttcccctttttttgtacctttagtaggccagcactttgcatacattggctataatcttcacatagacatgccgaggtagatattttttccccagttttactgataagaaatctcaggctctgaaaggataagtgaattttatattaatacattcactggatagtaaatggagttgctggatttccagtcctggtctatctcattgaaagcctgttctcttttcaactgcctttcagtaacaggtgctgttgtcactgaatccttagcttcctgacccatactatctgaataatgatccctacatacttctaggaaagaaagatatcaactgcaattacccctatttgacagatggagatcctggattgctctaagtttaagcaaagcaattaagcttggccaaggtgtctgccatgggaaagcagattcactccattgcttcttagattcaaatactgcaatgtattgattattgcatgaatatattcagtggcttgatataacaaagtggcccatcactcttgatcattctcaatatcagtgtgcccaaaccctcaaatgacttgccggaagcttatatattaagggaaacttccagaatgcaatggaaaatgaaactttgtttcactagaatagattctgttcttgaagagagaataggacaatagatttggttttcatggatcaattctcattcttcaaaacttctgcaattatctgtcgaatttaaatttagctcaagtgaacactagtttccaggatgggttcaggagctcaaacttgatagctaaaggagaggtgaatggctaaaatacctccattcttgtgagcttaaatttatacataaaagtgtcaaatcactccacaaaatcactgagctttcctttttattttactttttacatttaattgctgggcagttgaacattacagggcaggctactgcatcagtactaggtgccttgctctgccatcattttgtcagttgttctgtgtgtcaaatatattattctgtttgcaaaagtcagccactgacttttaacattgtcatcatctcattctattccccactcctttttgggcagagtaaatctttctaaagacaagggcaagagaagtcactaagttattggctgccctttttcactgaacccaaagagaatacattgaagtgtcaagtgagtgagcttccaccgcttctcagcctatcatcattactggcagagaaaccagtaagtcaacccaagacagcaacggagatatgtaactatgggatgtgttgctttcaagagaattgcaactcagagctctttctagcacgtggaatcaatttaacccttttatacataagccaaagtcctcccttcatgactcagttatttgagttaataaagctctccaaatctgtctagtcctttagctaaacagtgttaactaaaccatgtgaatctcctcctctaattaacagctactttattaaaatgctattgccctgttgggaactagttggcagggtgacagagaatggagtttgtgctatggactattgattttcagttaaattcttactgtgctcttggctttctcctgcttgtggcttaaagtacccaaaccattcaggccagcaaaagaggccactttgctctccctggtttttattggcctcttttcagaaggtctaattaacctatggagtcttccaaatttaccgacagctctttcatattaatctctcttctaatataagaaatttcttttttaaccttccactcaaaaagattatttcaaaaagtgcccacaactgaaggagtgacttaatcaggttctcaaggaaaatgcctctctttactttgcaccttaagctctgccattgttattttatgttttgtgcatatatgaacttttcattcctgtctttaaaatatttatcagtcatataaaatttggataatggtgagaagcacaaagaaggagataaaaatcagcaaccagataccaactacaatattgtaaatatttaggcaatatagtccttgaggacttagattttcgattagacatcactgtcattcattacatcagtaggtgaatgagacaaattaattcaggaagctataaatgatgggaaatctctggtatgtcaatgtaggataggtgaaggctggcaagagagttctggtttagaagtggttagaaaagatctctgtgaaggctgaggaggagcaatctaggcaatgcctccaggtaggaacatggttgtcctgattgaggctaggacctttagagtcatggacaaggtaggccgtggttgatcttaggttagtaatgcaggagaagacagttcatgtatgcttttggtactatggtgaggaattcagattttattttcagtgtggtgagatgccattattgggcttcaagcaagggacctatatgatagggtctataggtttttgtttctctcttaaaattttttttttttttttgagatggagtctcgctctgttgcccaggttggagtggagtggtgcaatctagtctcactgcaacctccacctcctgggttcaagtgattctcctgcctcggcctcctgagtagctgagactacaggcatgcaccaccatgtctggctaatttttgcatttttattagagatggtgtttcaccatgttgaccaggctggtctcgaactcctaacagggatccacctgtgtaggcctcccaatgtgctgggattacaggcgtgagccacagcacctggcaaaattttttaattggtacataatatttgtacataattatggagtagatgtcatattttgttacatgcatagaatgtgtaatgatcaactcaggatatttaggatattcatcacctggagtatttatcatttctgtgtgttggaagatttcaagtcctctcttcttgctatttacaaatgtacaatatattgttgctaactctagtcaccttattctgctatgtaacattagaactccttccatctaactctacatttgtactcattaaccaacccctctttatcactctcactcgaaccactgccctttacacacacacaccctccccagcctctggtatgtatcattttactctctacctccatgaataactctggctgctgtatggagaatggattttagagagcaagagtgcaagtagcaggggggagatttggagtcaagagatggcagtacttggctgaaggttggtagtgagaggtaagaaaagaaaacagtcaagaaaaatgatatttttgcttattcatattaggaaaactaggtggggagctagtttggggaaggaaagcaaataagagttctggttttggacatgtgaactttcaacttggttatagtagtgtggaattcaagggagaagttaggattcaagatataaatcaactagtaaaggagaagttataggagttattatagtatttagccttctaatctttttcatggtttgatttaatatttttagaaaagactggcactctaatatctgtttatgccctatataacttatttattaaaacatggtatgtgcatttatatatctatgtatagatagacataaaaaatattttcatgtatatttttatataagtactatattgcattccattgtatggatgctaccatttgctaatcagttctctacaactggacatttatgctgttatattttattaatttataaatgtggtagcttttcaataaatcttgacaaatattcagttttttttctagaacaaattttcaatgagaagtagtactgggagaaattttaagaatttttatataaaaatacgatttgcattccatatcagacacctaatgatggatgctcaataattatttatttgcagactgattacagtctcattaggattacataaaggtgacattttctcttggctttggcaaaaccgaatagtgcaatttataataatgtcaattttgtaggcaaaatagcttatttattttacatatgtaaaattagggaaatgttaatatttttcatacttttcattaggcatttgttcttttgtaaacattcactcatagttgtttcctgcttttgaataggtgatcatttttttcctcattgtaaaaactctaaatacatatagaatatttaaatttttatcataaatatattacatacttgttttctttcatatttgttatttacttcttaattgcatttgtgagtttcttttttttgagagggggcgtgacagaggaatgtacaggagactttagtattttatgttgctaaagtagacttttaaaatattctaaaggaaaataagccttggaaatctaagaattattttttgtgaattgaaaaaattctcaatattccaacagactcaaataaatagctgagtaaagctaagtacatctagtcaacattttaaaatcatcttcccatttgttttcttgctattcattttttatttgtcccatctgttctttgttctcttttcctgttttctactttttttagattaattgaattttttatttttatttttaatttattattaattttttttgtgatggagtttcactcttgttgcccagactggagtgcaacagcgcgatctcagctcaccacaacctccgcctcccaggttcaagcaattctcctgcctcagcctccccagtagctgggattacaggcatgcaccaccacgcccggctaattttgtatttttagtagagatagggtttctccatgttgaggctggtctctaactcctgacctcaggtgatccgcccgccttggcctcccaaagtgctgggattacaggcatgagccaccaggtccggcctgattgaattttttaatgattccatattatgttctttgttgacctattagctataaatctctgctttgtattttagtagctgttttaggatttttcatatatctctttaactattaaaatctatatttgtgatattataatacttcatgtgtaggaaaattgccttacaataagttttttcattttgcctctcctggtctttgtggtattgttacatatatttcacttttgcccatattataaatactatattgcattgctattatttttgtttaagcaatcaataattgtttaaggatatttaaataattatgtctatatatacacacatatatatgtatatatagaaaaatatatatatttactaatttagttaccatttctggtgctcttcattcttttgtttagatcaatataatcatctggtattattttccttctgcctggaggacttgctttaacatttcaagtagtgtgggtctgctgctgacgaattcatacaaattttgtaagtctgaaacagtctttatttatcttcattactgaaaggtatttttttctcagtagtttttttttattccctccttggtattttaaagatgtgcttgactgtcttcttgctcgcattattttgataagaaatctgccatctttcttatctttgttcctatgtatgtaacgcatcttttctctctgcctgtttgtaagattttctttttatcacagatttttaaaaatttgattatgatgcacctttatatagttttattctttttaaattattttttcaaatgtggcttctatttcaactgattgaattttttcttcctcattggtcttatttttctgctttttttgcatgcctagtaattttttattcaatgtcagacattgcaaattttacttgttgggagattttattattattcataaaatttttagttttattctggcatgcaattaatttacttggtaagtgtttcattctgttagttcctgtttttatgattcgtaggctggactaaggcagtattcagtctagaacttattatttccctctccttatatatgactctctcaatagtaaacaaaatgattcttaagtctgaatatgacttagtggcagtggcatccaaaggggcagggtgatgggagtgttccaccctgtagagaattttataataattgctgtgtttactgtaaaattttataaaatatgtataagcttcatattagcacattattattacttattatattttttatatgaaggttaattcagagaactcccaatttcataattatctcctagcacacatgggctcagccacagttatttgttttcagaataagttcttttgggtttatcattgtttaaacttgtgataagcgtttgttgtacttttgtaaatatttgcttatatttaccaccttctttttaatacgtgattgtttttgtttttctcattttaaaaactccaaatacataaagattattgaatggtgtgtttatcataaatatatttcacacttgttttcttttatgtttgttatttacctattaattgtattaatgggattcttcatttttttgaagggggaaagcgtgagagggatgtacagaagagtttcttcttttatattgctaaagtagcccatcttaagattttttaaaggaaaaaaaaacccttggaaaactaagaattatgttttggaaattgaatatttgtcaatattattcctcctccttagacatgactctcttaataataaacaaaatgactattaatttaactctgaatatgactttgaatattttctctttgtgcagcctaagattgctgcatttgtcttctttctatggtagtacctgttttcatgtaggatcgttcccctaaatgtttgtcaacatttggctgtctgcttatattaaaaatgctgtgcttgaaacctattccaaggctctccgtgggtaggtggctgggaattgtccatttggcttctctcttggaagatcccagtaggaaaccctcaacatcagtatcttcaggtcatattctttggagtggtcagagtccccagagaaagaaaacattcctccactcttctacagatgtgaaatacacttgcccatcaaaatatggagagatagatgaggaaagaataatgaaagtatcaatacataatctcgagttttgagctttttcttttctcacaatgttacaacctcatccaaccagactacctagaatagtgatcatggttgacatgtgcagtcctcacctgtgaatgatatacctcagtcctggggatttctgatttaccctttgcagggaattaccctcccatctgtttccatagtggtgcaaggtaattaacccagcagtgtggagtggcctaatgtgagagaaagttctgtttgtttcttaaccagattcacagaagttctccatttttaaaattgtgctttctacatcccaattttagaggtatcatttctgccattttctcagattttggaatttttagaatctaaattgagtttccatcaatttttctgacttctagataaactgttcacctttctctggcctgctgagtcagttacattattctctgctttctagcatccaaaaggtgttttgttgattcttataccctttgttctttttaattcatgccttcctacaattcctttactagagatttattgcagtttcatgatgaagttgacctcagtactgtattcagcttaccatcttaatactcacatatctgcaaacatctttccatagcaattatgtgaagaaagcgacgagcatatgtgtaaaattttatttcagcttcatattggtatctttatgcacacctgtgtagttcttttattcttataattctaaaatgttggctagatgtacttaggtttgtatagtcatttgttttgaatgttaagaattttcaatttacaaaaatactctttttcaagagtggctatcttttaggatatcttaatcattttttttcccactttttaaagatctggtattttcttaaggaacaattatctatatttcagaattctatactcatccttctttatatattattagtttttgtaactttgtatcttttgtttttcacttcccttctgaattctaaaaatgttcttgtgttttaatttttttaattttttatttttttattatactttgagttttagggtatattacttacatctctgtaaaatgaattttgcttaatactacttccagtgtaaattttgattctacaatttgatttgtactcttccttaaaatatttctttatttcacctatctttcttataatttcactcattttgttttgcatttctacttgctctctctgtaatatttttcctgttttcttaatattcatttatttttattctctattaaagattatgtgtagtttcttctaagtttttctgatctttcagtatatcatttttattattctgttttttctgagtctattgatttttctttatattgttttccaacatttcttatttttttctttattcacctttaaatgaggtaggattttggttgatatttgttctactgttagcctacttgtgtgtaaacaaattagcttctcagataagatttcaagacttaagtttttcatgtgtgtttttttttttttgatagaccactgatctatggatatgagatattttctatctccactgttttgttctttaattctctgaactgctgtagtgcattaacaaatgttagtttctggttcacttttctatatccaaattctatactcaacacattaccagagataacttcacaacagaatagaccattctaatggagtcccatctgttcctggcctatgggtttctgaaatataccaccttttctcttgtgcagaaaaatggcatgggtgagaaaaggtctaacataatgttcagctcacagagtactactgtccaaaagacagagagagcaagcatgtggccgggtcttcagattagtagttacttgacttctgagtcaataaacagtaagtaggtaatattaaaatcatagcccaacatttttcaggcagtacctctgtattcccttgaacttaatatgcgtcttgtccaaacctgggtatttattttctccatgaaaatccatatggttcaccattcaacacctgattctgagtctcagctttttcatttattagttgtttgaccttgggcgaagtctcactaaagcttaattttctcatttttaaaatggggaataattgtgagaattgaatgagatgatgtttataaaacttgtggtatatatatatatatatatatatatatatatatatatatatatgtaaatatatataggtatataataagcatcattaaatgttaatggccatcattacaaatagagtcagctttttcaaaattgccattcgattgccagccttcagttttgatagtattgtgagtttccatatttttctttttctcacccccaattgatattccaatcagaaggtaggagaagtcatattataagttaatattgtttcaatccaaaatctctttaattttaacatttctatgttaatttgatttatgggtgttgtcagattgttttatgcagtctgagatcatttgtcttcatgtgaaggagctgaagacattaatattgattatgataatagatactctggctttattagtgtcattattttctattttctttcattttcttttcctcccatttttgtttaattctcatttagtctcctggtgcaattcaatcaatgtatttggtatgaagtatttcaaaaatagaagtcccatttttgcataaattaaaataatgtggaaagtagagacgcatcaaatcaatcattctttctcccctagttgcctggcccagtgatgtactaaaagatgaagtatactccttactagcaaggtttttcctctctttgcccagcagccctaccttacttcccaccaacatgtcctccgagccacaccttccaggatttaaagcactgcttctactttgccagcaccaaagaaaatctgtgtagagaattcttggcttagttgctctctgatagatgctgtatagaatgatataggtcataaatgggagtatgatggaaggggaagcagttatcttgcagccactaaggacctggaagcaagatgtttccttcatcagagcaggttaaattcagctgcgagtattacagttcaagttagtggcttaagcaaaatagaactacatatttcttccatgtaggagtagttcagaggtaggcaattcaagaattcatggttccaggaactcaaaaacttgctcttgtttctcatgcctggctgcttacataaccaaaattgcttcatgattcaaaataactgttgatattctggccactgcatccacgtttcatgtagcaggaaaggtaaagagggaagaacaaggatatcccttccttttaagagaatcttaagaagtgtcatgacaacactgcttcctatatcttataagatcttagtagccacacctggttgtaagaggtgataaggaatgacatttttatcactcagcaatgtgcacagctaaaataccaggattcatttacatcagaataaaggtaaatggaatttgggctaattattgcactgtgacacatctgttctgtgtttggggttgatgaaaatgccccgtatcacatcagtagcagccagtgatggaaataccaagtgtgctctgaacacctgcatggggtttctattgaggaagtgagactcaagcttactgtttcctgctgcactccattggaattaaaattggtgaacagatttctatgattcctgcgctcattgctctttttatcctattagtggacaactaataaacaaagagaatttaaagtcaagtctactgaagtggccaaccgtgttgtctaaaaggctaagaatgtgaatgttttctgacaggtacattacagcagttttcattttaaaatttatacccaagaatatgtgggttactgcttgtctttgatttatttttaatgtggacaatgaaccccaaacatgaagaagatggtttggcgaaatgtttgtaacatatgtcctttgggaagtggcttcataaactggagaatagaacaagaaatctacgcttaaatctcagcttcaagacttcaggatcccaagtggtgatcctggggctactgctaaaattcactgagattcagcttgattatatatgaaaacagagatcaccttcaatctcatcagccacagaacctgtcacactgtgtgcatctctatctccatgcctggggtcatgcctttatgcatgtaaatttaatggtctcctcattctaacttcctataagattgaaacacagaggtctgcggggcctttcccgcttgacccataatgtaatgtaaagacccatcctaacactggccttgtgatgggccctccctgtctcccttcttttacatcattcccaacaaaagcaacccatcatagttattttactaatagttgagtaaaaaatgtaaaattacctctctctctattacttttagaatgtataaaaatcaacagggagtcttcaccacaggctcctaatatgaaagtgtctgtgcaggaaaatccataagctagggtgacttttgagttaaattaaattttatggctcaaaaaatgctttgcttggttttcactaccattataaagcaaagaggataatttcagattcagtttctacaaaggattgctttgggttgatacaggctttatgttagtggcatggaagtatttgcatctgcacattgatatgtagtgaaataggctgtaaaagataagatcaatttcctgttaaaggtaaaaaggccaatgtagccagatacattaagttttttttttttccatttgtcattcaggactgtttgacagttttacattagctgtgaaaggcaccaactggtacactactgtcaagacttagaaagtaggcacacgtacacaaacacgcacacatgctgatgtaaaatataaatataaacagatagaagcctggaccatacatatgagtgccaaaaatgcagttgtcacatgcatacacacctattaaaacatagcaacacaatcttatagcaaagacatgcacacacaggtacaaggacattgaccagatgacacaatgacacagctgggattgacaattacaggtgagcaagcaagatgagggctaatgtccataggagccaagagacctagagaccctcatgtaaacacacagagatgtatgcatatgtgaacacacacacacacacacacacacacacacgcatgaaaagagagacccagagacaaggccagacaagaacacaaagatcaacacttacgtacacataactaaaaggcatgctccaaagtgtgctagagactcagaaacatagaccctcactcattcatgtagccacggcctcctgacctctggttagctatgttttcattttgtactgagacctttaaagtaatttatttgcttcaagactcttcattgactcctccttcgtccgttatatttggtctactttgaagtgtaattcatttcaaattatgtttttaggtttaattcctacaattcaggttctcatgcatcatctggactattacagtggctaccggaaattacctggagtccgtctagccctccccaagtcattcaaaattacccatgtgtggtacatcattactgggtagaagaactgcttctaaaaccaaaaaataacatagagttcattgagtccattttatatgtaaaattttgaaagactagtagtcccattattgcacacacatcaattccaaattgttcttttcaaccttgagtaatttcaaggttgaaattaaccattctcctttatcttttatcctctatccctttacctttatctcccttcatacttacctctttccagccacttaaattttccttgtttcctctttatgcacatgtttttttcgtatctccataattttgcccatcattaagccaatctttcctcattctagcctcctttaataatgctaatatgaatagttgcctggcccttcgctctgacaattacatcctatttcttctgtttgttttaagtttagaaatcccacctgtattcaagatctcattcatttatatttcaagccttaattagtaggctgtatcctcttgtagctataagtagcacagagcttagtactgtacttaatttttctttcagtccttttcaatatatcagttctccccaaatgaaatacagtcttccagaagacaggatctccactttcttcttatccttggcattttccaacccctggctcactctgttatgattttgagcactccacatcctcatactggggcatctagttcctgctgcttaaacttctgactcccaatgctgtatcctcaatcccagttagaattccaaactccagatctctacttcccattttctaatgattgaagcctatttaagccccatggattaatttcaatttacaaattcctgaaacagtacaaccctttcccattatcttactctaaattgatttttccctctcttttttaaaaaaattatggttaattgtcctaccatacatccagtcatccaagttagaatctcaggcattaatttttaccttcttgtttcctttgtttcttccccaacattagggacattaagacctacccttatatggccttgctacccatcactttctgtcatcctctctgagtgctgctctgggccatcccctcaccaacacgaggtcaggcaagaggggatgattggcttcaagctgcttctttgcttgcaattttgcctcctgtgatcagcctctctgatgctaacagaatcatcattctgaaagacaaacctgatcttgtctttcttattgaaaaaaaactttaaaggctcaagagtgccctcaaataaagtccaacctcctttagcagcagcgccttttacagcatcaccttgacctaccatctcagctcaaccatcccttcccttccatttgcatccagactatactttcctctaaatgctgaatacatcatgtctgtgatcattgtttaccaatttccctttatccaaatgcttcatttactgttctacctgggaaactatgctagattttcaagactcagttctgaaggcatccacaatttgctctgggaaaattaaacatttccataacatgttctacaaacttgtaagatagcactcattatgtggttagctgttcacatatctttctccctaattggactgtaagtccttagagaatagatcctatatcttatccatcattgtctgcccagtatgatgtcaggtaatctgtgcatagaattattggctaagttgctcatgccaaaaaatacatactttggtagacggatactatttattgcctacctaatataaattctctagttgatatatatcatttcatttgatttctacagtaactccatgatatagttgcaattgttcctgttttcctagtgagatatctgtggtctagagaaaataagaatttgaccaggttagtctgtttacttttcttttagcccatcatactctttccgtcagcagaattgaaaacgtgttcataagacattacccttgcatccaacttaggaagctctggaataaacaacaggagcaagtttcttcttgtagtagttctcaaagtctttaatacattaatatgaatcttcaagtttgtctatactgcacagtacttcccagatctattggctttagaagccattttatgagattctcatgcaggatatcctttgggaaatgtaaccttatatgaaaatgctgtctttaaataacttctggtgttcttagtctttaggagagaactcctctttcccaactctttctcaggagcatatacacatccctacccaagtgcttcttcagtgatactaatttctgactgaagtgattggcacatcacatcctggaatcctggagacctcctcctgttatatgcctctttttgctctcagcagagaggagagagatagaaatgcatgcttgctgctccctatatgtttctatccatgcccaaacacgtaggctaccctctgtcacagagcacactgaaggggagagaatgcttggattgagctgattgaactccttggttgtctcccatctccagcggtgtttggtttgggttgaatgctgtagagttgcctgtaccttctgcactctacaggagaagctgatttatttttatctctgtctgagaacaacaacatggcatcccctgatccccctggtaatttcctgggctcaatgattgctgttttccttgacctgtttcacagctggtggcactgctactgacctggatttgttttccttagctcaaatgacatagtagcccaggagatgcatggatttgacaacacaaagcctcgatttttaaaacaagacacacacacacacacacacacacaaacacacacacacactcggagggtttttggagtcagagagaacatcagttccacccctagctccaagactccaaatttcaggtctgctgcttgccaattaggacaagttactcaacatcgtagcctaccctttccttacctgcgtaataatgataatattatctacctctccgggttgtgaagaggattaaataagataccttagtgccttgaagatagcagcagtcacttaatgtttgctatgtttatattactatcatttttcaatttagacttttattgtttccctttattacatttactgtatattttctttctcatgaactacctatctaggcctgattgtgtgttttttaatctaaggagaaactaaaagaaaaatctattgatcctttctacaaagggtttgtgattatctgaggaaattaatcataaacataggaaaaggttacctatgatatatgcaatattttaattatttttaaaagaaaaggttactttgtagataaactttttagataaatccattaacactcaagtttaatgtttacataataactgagtacaaagaccaagatttgaaaagaagttttttatgtgcgtattacttagagcataatccaactaaaccagtggaactaaaaactttcaagcctagaaagtttagattcttagaataattttttttgacatggtttttctttgtcatgaaggctagagtacactggagaaatcacagctcgctgccacttctacctcttgggcctatgtgatcctcccacctcagcctcacgggtagctgggaccacaggcgtgcgccaccacatccagctaatattttctatttttttgtagagacagaatcttgttattaaacatgaacaaatgggataaactaaaagaaagattaattcagtctaccaagactaaattagaaagaaattaaaaatcggaacagacctataaccagtaaggagaagaaaaaatattgccctggttgatctcaaactcctggcctcaagcagtcctcctgcctcagcctccaaaagtgctgggattataggtgtgaggcactgtgcccagcccatgtaaattatcgaagagcccaaagagcttttgcttatgtgggtcttacccatcaatattaatgatagtaaaattaatatgagaagacttttaaaatattttattggttaatgtagaaaataaaaataaaaccaatgtattataaatattctaatgaaaaataaattattttccaaaacgccctcacacataaaaatgagaaaaagggatgatgtacatgcatatgtttcattgtgattaaaaatgcataaaataaaatttccccttttaacaaaattataagtataaaagacagtattaactataagcacgatgaggtacagcagatctctagaagtttttcattttatgtgactaatactttatatctattgaaaagcaactgctcggttagccctttgcccaggcctgggaaaaatcattctactttctgcttctatgagtttgactattttagatactttatataagtggaatcgagcagtatttgcccttctgtgactgacttatttcacttagcataatatcctgaagatccatccatgttgtagcatttgacagaattttcttctttttatggctaaatagtattttattgtatgtatttacaaaatgctgtttacctatcaaaggtcatttaggttttttatatctcttggttatagtgagtaatgctgcaatgaatatgggagtgcagatatctctctttgagatcctaatttcagttatgttagataaatacccaaaagtaggatggctcaatcatattatagttctatttttaaattcttaaagaagacttcatagtgttttccatagcatctgcaccattttaggtattccaaccagcagttcacaggggttacagtttttccacatttttgtcaacacttgttattttatgtttttctttatctttgtaaataaatataatggccataccaacaggtatgaagtgatatctcattataattttgattttcatttttctgatgatcaatgatattgaaaatcttttcatatacctattggcatttgtatgttttctttgaagaaatgtttattcaggccctttgctcatttcaaatcagataattggagctttttttgctactgaactataggagtttttttaaaaattatattttaagtgttaaccctttatcagatatatggttggaaatattttctcctattgtgtaggttaccttttcactctgttaattgtttcttttgctgtgcagaagctttttagtttgatttagtctcacttatctattttttcttttgttgtctattctttcgctgtcatatcaaaaaatgcatttccaagaataatgtcatgaagcttttcccttgtggtttattttaggagttttacagtttcaggtcttacatgtaagtctttaccacattttgagttgctttttatatatgctgcaatatatggattccatttcattgttttgcatatggatttccagttttctgaacatcatttgtttaagaggctatcttttctccattatgttcttggcatccttgtcaatgattatttgacgataaatgcattggtttatttctgggctgtgttctctgttcccttgactatatgtttgtcttatgccagtaccatatttttttattactgtagctttgtaatatgttttgaaattacagagtatgaggactctgacattcctcttctttttcaagagtgttttaactatttggggtcctttgtggttgcatattaatcttttcttttatttctgtaaagattgccttggggttttggaaaggactgcattgaatctgtagattgctttgataccatagacattttaataatatagtattaagtcttccagtcaagaaaagtagaatgtatttccatttatttgtgtttttcaaaatttctttcagtaacattttgtagttttcagcatataagtctttcttctccttgcttaactttattcctaagtgttttattatttttaatgctattgtaaatgtaattatttttttaattttcttttcagattgttcattgttagtgtataaacacaactgatttttgcatgttgattttatatactacaacttttgttgaatttatttattagttctgacaggtttttgtgtgtgtgtgtgtgaaatccttaggagtttcttcatataagatcatgtcatctgtgagtagagattattttatttcttttcatttttgattattttatttctttttcttgttaaattgctcacactagaacttcagtacaatattgaatagaagtggcatgagtgacatccttgcctcgttcctgaccttaggggaaaagcattcaggttttaactgttgaatatgttgctagtggtgagcttattggatatggcctttattatgtttggtaatttccttctattcctagtttgttgagtgattttattatgacagaacattaaattttttcaaattctttttctgtatatcttgagatgatcatgtgatttttatcctttattctgttaatgtggtgtatcaccttgattaatttttgtctgttgaactatcctttcatcatagggataaattccacttggtaaaaaagtatataatcctcttagtgcgctgttgaatttgatttgttaatattttgttgagatttttacatgcatattcatcaggaatattgacttgtagattccttttcttgcagtgtctttttctgcctttggcttcagggtaatgctagccttatacatgagtttggagggggcccctcaaccacttctcaattatttggaagatttgagaagaactgttgttaattcctctttaagtgtttagtagaatttaccagtgaagccattggtcctgagtttttccttgttggatagttttttgttgttgtttttgtttgttatgtttggtgttttaactgattcagtcaccttacttgttataggtctgttctgatttttcatttctttctaatttagtcttggtagactgaatttatctgtttcttttagtttatcccatttgttggtgtttaattactcatagtaatttattataaccctttatatttctgtggcatcaatgtctcctctttcatttctaattctcttcatttaactattttctctcttttcttagtttagataaatgtttatcaagtttatctatcttttcagaaaacagctattagttttggttttttattgtttctattctctattttatttatttttgttctaaccttcattattttctcctttctggtagctttggatccagtttggtcttttcctagtttatcaagttgtagaattaggttgattatttgagatctttctcctttttaagatctttcttcttttttaatgtcagtgttcattgcaatatacttctctcttactactgcttttgctgcatgccataaaattgggtatgctgtgacttattttcatttgtctcaagatatttctaatttcccatttgattactttttaattcagtggttgttccagagtgtattgtttaattttcaactattagtgaactttctaggttcattttggtatttatttctaatttcattccactgtagttagaaaacatacttttgataagttagtcctcttaaatttgttaggacaagtcttgtgacctaacatgtaatctatcctgtagaatgtactgtgtatacctgagaagaaagtttattctgcttttactgactggaatgatccatatttgtttataaggcccatttgttttatattgtgcaagttctctttccttattgatcttctgtctgaatgttctggccattattgaaagtgggtattgaaaggttctactgttattgtgttgctgtgtatttctcccttcagttctgtcaatgtttgcttcatatgtttagatgctctgatattgtatacatatgtatttataagtgttatatcatcttggtgaattgacctttttatcattatataatatccttgctcttgtgacagtttttgacttaaaatgtattttgtctggtataagtatggccatcctgctctatttttttttctttttgaatggaacatgtttttttttccatactttcagtttcaacaaatttgtccttaaatctgtatagtcttttgtaggcagcagataattgtatctttttaatctactctgccactctatgtcttctgattgaggagtttaatgcattcacattaaaggagttcttgaaaaggaaggacttctttttgccattttgttgactgttttctttcgtttttgtagtgcttctggtcctctttgtctcttttgatatcttcctttatgtttcattgattttttatagtgacatgcattgttttctttctcatttatcttctataaatattatctttagcattaccatggggcttacataatcatattatagctttaatagtctattttaagctgataacaacttaacttcaatcacatacaaaaactcttcactttaacctctgtcctcctctaccctttatgttactgataccacaaattacatctttttatgttgtgtatcaaatagtatatttttatagttattgctatttttatgcttttgtctttcaacttctaaaccagaattaaaattgatttatgcaccatgcttacagtattatagtattgtatatttttaatatatttatctttaccagtgaactttatattttatatgttttcagtttatcatttagcatctttcagtttcaatttttagtactccattagcatttttttgtagggcaggtctagtggagtggaactccctcagttttgttcatctgagaaagtacataccttcattttttaaggagagttttgccaggtataatattcttgtttggcattttttaagctctatgaatatatcatccaacttcatttttgactgcaaggtttctgctgagaaatccactgatagtgttatgagagttttcttctacataatgattggatttctgcttgctgctttcaaaattctctttgtctttgaattttgacagttagattatatgtgtcagtgtggacttccttgggttcatcttattggggattcatttgccttcttgaatctgagtgcatttttccttctccagatttgtgatgtttttgttgtttctgtccagtaattttttaaataaacttttttttcttttctctctatctctttcctctctctgttctcccctgggactcccataattcatgtagtggccagcttgataactttccataagtcacttgggctttcttcattctgtttttcattcttttttcctttttgctcctctgactgtataatttcaaatgacctttctttgggttcgttaactcatatatctccttagtcaagtcagctgttgaaccattctagtgaatttttcagttcagttattgcattcttcaggtgcaaactttgttttgctttttaaactatatcttctatatttttgtctgcggaccacatactgagaactgctggtctcagctgctgtaacaaatatacccaagaatacagaagatcaaacaagatatttaataaaataatatttgctcatgtaattgtctaatgcagtggttctcaactaggggaaattttgcccctcagaggtatttggcaatgtctagagacatttttggttgccatgactggggagagagaagttactggcatccagggatgcaactaaacatcttaaatatacaaaacaatctcccagaacaaagaattatctaacctcaaatgacaagttgaggtacagaaactctggcttaaagatgggagttgaggtgaggaagatggttatctcctccgcaagatcatctaagggctgaggttccttcttttctagttgtcgtgttgtttcccaaggagttgcccttgtctacagagtaagtcctgcctcactgggataacatctacttttttgcaagaggaatagaattacatgagcaattaggtaagcaaatatccttttatcttgtttgaccttctgtattcttgggtatatttgttatagaagctgagaccagtggttttcaaggtgtggtctgcagagaaccttataggaaatatctggtgtcaaaactatttttataataatgctaagatattatttacacttttcactgtcttgacatttgcaccgatagtataaaatcaatgtctgataaaactgctggctgcttagtacaaatcagctgcttagttgagaacaataaatggactcaagaaaataacgtggaagttgtacacatccttccatctacttacattccattggtaagaacttgtccaaatggtgaggctaagaccttgacatggaggaaggagtccatttaaaagggaaattcagggaatggtttctggggaaacactggcaatatctgccctgatagagaaatgctttaaagcttttgaaggcatgctcaaagaagtcagaggccttttatcatagaacaacttgaaatttttatttatgtataataatactttctatatgtaaaagaaacacatttcttgttatattttgcaaacccatgacttacaatgaatttgccattcactttctggagacaattaattcctcggggatataataaatattcttgcccaaacgaagaatgtgttactttggaagaggtcattagcttctacaaaatgtaagtaagctgatatcttactggtttatgggacttatctttgggctttattaaaatcctgcatttttaacttgaaaaagaaaaggaagacagacattgacttactgtcaaaatcaacaaggtctggatgaaggccccttgaaagtctcatccctgtgagccggtaaacatttatatctaatttgaaatgagatgcttaattacataatttcattccaattaagctgctaattaattgacagggcacctttgagagctttacacagtgcaagtaaaaggcaactacatcttgagtctattacctatgaccgtttgggagagatcagtaaataactatttaagaggctggagacagagtttgcaagaagagaaaacaagaggctagccctgggagatccagactcaggaccagtcctggccaagactcttttgagcttttttttcagtctatttcttgagtgagtaatgaaaggaaacaaaagaaaaaaaattctcttactgagcatttactacatgtatgtgctaggaagctgcaaatgaaaaatgtaagatgctagactatctgcccagttgttgttttaagtaacactgttgtttgggcattaagtaagtagttttgctatctccctggtatttaacttagccaggtctttcttcttgtttttccatctctgagctttattctggggtcaaattaaagcttattttgtgtacagatcatcaatgtctatttaatctccccagagggtagtaatgcttttgttgatagtgaaaacaattccaaattgacatcagtttttcaaaataaaatggattattttactacttgcatactgcagcttattagagtagaaacatataacaataaacatctattcatacacacatgcatgatacttcacttgcctgcactggagaagaaattattggaatgtatctttttcatccagtttaatgcagaagcagaaacctagggtggacaagctggttgtctcattactgaacattactgttgactcaagagtctttccacattacttcagaaatgctccaggactgcattatcacatctttacatctcatcattggttttattctaaaaaattaatgaaacaagttcgagttaggtttatcattcaatctaaagagtttcgtgtagtatatcacccactattatcacctagtccataactggcatcatgcatctttttaaaaatattatttgaataggtacgtttcctcacagatatatcaactattgtgcatatctctagttctgattctagttaatcaatatcagcagaaagcttatcatttcatgtctaagtgtctgtgtgggcatgaaattgttaggaattgttttagtgaataactgattcaaaaattcattgcttaaaaacaagatttttttttacagaagcattcagaactccaaagagattataactcacagagaattattttaaaaagcagataatatcttattccttttttccacacatctccacataccaacttaaatcttcaccagtaaagaggaatccaggggaaatcataagagaagcatctttgctatcctcgctgaagtgagagacagtgaacttttcctttgctcatactcagtgcctagaatcacctaggaaagccccttcccatgggaactcagcagccatgagcaagctgcccttacaggctccatcctggtcactgacaggttactccggctgtgaccactgaggtccacttccactaatgcctcagaattttaacctgagcctgacaaatttgcagggtatgtgggcacacattactgtatattgcagctggaatgcaaacaaagtggaccttaatggcaattaaatcccaacccctcattgtacagatgaggacctttaaatgcagataggtgacaagcaaatatttggttgtggtcaatgttaatgttgaattgattacttaatcaaaaatcacgagattgatccatatttagacaaacatctatgggcttacacaccgatggaatttacaccttatgtatctgtatacattatagactttctggacattcaaatccctttcgtagaagattctgaggctttgagatactggactctggtctggtaagacttgtttctctccacatggtactgccagctgtaacacagggaatcccacttaggagcatatgcagggaaaatgatcatcactttgccaagccctgttttatccttacttcctggcatcaaagctatcttacctgatcttactttccactagaatagagcccaatctaggccatcacccaaaaactggaggagactttttggtagatacttgtaattgagtttattttcatatatttagtttaatgcaaaatataaattaatgaataaaataaaatattcagaatgtctttttttaagccaagatgataagcattccttagaatgtatgtgatggagtaatatgacacatgtggactagaatattactgaggccgccaacagagatggcaacactaacaaaagtatggcttaacattcctaaagctttgatttgttgccttcttgagaggaggtagttttaattcgcttcttatatgccattaaggcatcgttgcctctggatatttatgtttacttatcagtttatgatagctattgatttttaacagttattttaaatctcttgaagaaacacatgcaaagatattttcaaaattcatagtttgctgttaatcacttatgtcctgaaactattgctaagcaaaagttttcattatttgttctttgagggagtataaatttaatttagagtgagaaggataaaacccaggattcgtcaccatcatttcaaaccagatactgtgattttttttgcggggaagaggttgagagaggcttcctggtttgctcctttgttgattttcttacatatttgacagtgtcaacattgaggctcaccagatcactgccaaagcccattgtgaagagtggctgggccagtgttttaattttggtatatattgaaaggatcgtattctataattgactatgttttacttagatggcattactgaatgtacattttcagaatttattttgaagactgacatcatagaagaagctcatctagaatactatgttcaagcctttgaaatactcaaagaactctatagattcagtgtaatccctatcaaaataccaatgacagtcttcacagaaatagaaaaaaaaaaacgtaaaatgtatatggaaccacaaaagagaatagctaaagctatcctaaggaaaacaaaactgaaggaatcatatttcctgacttcaaattatactacagaggtttagtaaccaaaacagcatggtactggcatacaaaaagacacagacatcaaaggaacagaatagagagcccagaaacaaatacacacacctacagtatactcatttttaacaaaggtaccaagaacatacactgtagaaaagacagtcacttcaataagtggtgctgggcaaattggatatatgcagaagaaggaaactagacccctatctatcaccatatacaaacatcaaatcaaaatggattaaaaagttaaacctaagacctcaaactatgaaagtactacaagaaagcattgcggaaaatatctaggacattggtctaggcaaagattttttgagcagtaccccagcataagcaaccaaagcaaatggacaaatgagatcacaaattgaaaagctactgcatagcaaaggatacagtcaacaaagtggagagataacccacagaacgggagaaaatagttgcaaactactcatctgacaaggaatcgataaccagaatatataaggagctcaaacaactctataggaaaaaatatctaataatctggtcaaaaaatgggcaaaagatttgaataaacatctctcaaaaaaagacctacaaatggcaaacacctatatgaaaaggtgctcaacatcattgatcatcaaagaagtgcacattaaaactacaatgagatagaaggtggtgtaccagaggctgggaagggtagcgggaggctatgggagaggtgagggtggttaatgggtaccaaagcaaatagatagaatgagtaagagctacaatttgatagcacaatagggtgactatagtcaataattactttattgcaaattttaaaataactgaaaaatgcaattggattttttgtagctcaagaataaaattaaagaacatggagaagggcaaaaaaaactaaaaacaaaaattaaaaattttaaaaagccatgaaataattaagtaaactggatattcacataatgaaatggctacttttgaaaacggtttaattttatataaatataaaaggtagcctcccacttcccttcccagcctctggtaactctccttttactctctgtgtccttgagttctgttttgatttttaaatcccacaaacaaatgagaatatgccatgcttgtctttctgtgcctgaatagttttgaataactctatgagaaaataaatcagagattttaccaaaataatagagttaaacataagatttttcaaaattttgtctcttttctagtttccttaataaatgtgtgtgttgttatatatattaagaaattttaggccaggcacagtgactcacacctgtaatcccagcactttgggaggccaaggcaggcagatcgcttgagcccaggagtgcaaaccagcctggccaacatgaggaaaccttgtctctactaaacataaaaaaattgggctgggcgtgatggctcacacctgtaatcccagcactttgggaggccaatgcgggcagatcacgaggttaggagttcgagaccagtctggccagcgtggtaaagccccgtctctactaaaatacaaaaaattagccaggtgtggcggcatgctcttgtaatcccagctacttgggaggcttaggtaggagaatcgcttgaacctgggaggtggaggttgcagtgagccgagatcgcaccactgcactccagcctgggtgacagagcaagacttttctccataaaaaataaataaataaataaattagccagatgtggtggcgagcacctgtaatcccagcttcttgggaggctgaggtagtagaatcacttgaacctgggaggtggaggttgcagtgagctgagatggcatcactcaactccagcctggacaacagagcgagaccccgcctgaaaataaaaaaacaaacaaacaaaaaaaacagagaaattttgaacaagatatagacgattccaaaaggagcaagcaatatggcatgcagttcagaacggggtcttccaaatacaggccctgacttggtcattgcaggccatgtgtctttgacaaaacacctttgcccaattacttttatagtgaaaaggggacaataatagtgcctactttctaaagttgctgagagggttgcattagaatgtcttcaaaaagcttatcacattgcctgtcacaaagtgatattaatgattatgttcataataccattaaaaaatttattactttctaagcaggaaaaaaaaaattcaaatttaggacagtcccataataagaattaatttattttaacaaataaagttatggcttttgttttaaattgaaatagataatttaagtactttctcttaattattttataaaatgtatggtgttttaacatatgcaaagttgatatcaattctattttcttaatctctcaaagttgccacattgctatagaaataactgtaaaaacatgtgatttttccttccacttgtatctgaacagcatttactcatttaatccaaaagctgaagagatgaaaaattgggagatagtggtttcactgttcacagacaagctttcccactggctctgtgacctcaaacaaattggtttactcctctgtgcctctgggccagtgaggaagctttcagctgccaactagggaagaaactcctgagaatgccttcagcaagagcgcagccaaggcagagtagctccagggctggttaattcagttactcaaggacagtatctaagatctaaggtttcctcccaactgtatttcctgcattcctccgtatctgttttcttctcatttttcccctcatgcacacatgttggcccaggcattacccacagatataactctagtagagacaggaatgaatatgtcttttctgttgtatgcttcgtaagactgagaatctccttcctacaactccccacctcaggatctccctgacgtggcactattcagaactgggtcacatgtcacccccagtcactgccaagaatagtgagattgctttgcttggttaaagcaggatgagcttgttagagtggttagattaatcaggatttgtctccgaggtggagaaggtttcttctgtctaggttggacagtttagcaacatttactttaggattgaattgacttgagtaacaatgcacaacatctgctgaatccttaatttttttagtctataaaatagggcaaagttcagttttatctaggtcacagaatttttaaaggataaaatgatataatgtcagctcaggcagttcaagcaagcctatgactctcaaatgaacagtggtgctttcatgataagtctaagaatccttggccaattatgtataaatgcaaccctagtctctccttcatctcctttcccactgttcagccatggctttcagagttcatcatttatttctacattgacagctaccccaatccccattccaaattcacatgatgataaaatgtacaaactagatgacttccaatcttcttattttcttaacaagtttgcaggagccattaataatgtagagcaaaatgcagtctcaggtgtgtataccaccaagatgtaacttacaaaggtaactctacaagagggaacttcattccatgttgtaaaactaccatgtattccttctgtgtaagtgggcacagggagaactcaaagtgtttatggcttagcatgcatgctttcttaccaaacactgttcttgtcccttgttgtggccattctgagttcttttatgcaaatgtgacccactaagaaggattgatttgtgctcaggcctcagccaatgcccattttcttatgccctgggatttgtttcctagctgcctctggccctgcggttgagggttcttgccagttcgattctaatacatgaacactttcctttcattctctctttctgatttccctttgcatttatctgctcccatcaatgcaaaatactgaatggttcaaattgattttccttctcaaaacaggaaaggtctgtttttcaaacttccgtacttcctaaggaaatgtctctgatcaatatgtgtaagaattaaggggaaacgccagactcccccttctgattgtcagtaactcagtgcaacccgtttacctcttaggattcttcccagcagaaaacgctaacaattgcaattatcaccattatgcagtatgttcaattgtacaatcaatgtaattgccaaatggaaattatacaataaatataattgctgctttactcctgtgcagtatttcagtggcacttcacatttattttgtcttttaattagtaacaggtataattgcagcactacactcagagctgaagctgaataatttgtgggagtgggcatagggtacagatattgaaagagggctgctgtggttcattctttgctggaattatctaaagatatccacctattgtctaaaacccacctaacagccctaaattgagctgacctgtggacacatttggtgtaaactccaggtaaaaaaattccctgcagttcctgaggcacatgactttgccatccctgctcttgacttcctgcatcccattgtccctattatttgtctatctagatgaatgtattaattcattgatttaataagcatttattgagcactgattatttacctgcaggagatatgtagtgaacaagagaggcatgaagcttaaaatctaggggaaaaatgcagagactacataaagagcgaatcaagtggtaggaaatgtaaggtgattagtgctaaaacatgctaagaacaaaaagttattatgacgtcataatatcttttgatttgatggtcagggagaacaactttccaagacatgatattcagcttgagatgataaaatgaggtaggttgttcaagtgggggtggaagaaggaagaaagtgagagagagagagagagagagagagtttgtgaggtgtgctggaagaggtagagagagaagagcttagatttagagggtttccacattataataaagaattagatatttattataagtgcaatgggaaaccaatggagagtttggtgcacgacagtgacataacttgatttctattttcttttactttttagacggagtctcactttgttacccaggctggagtgcagtggcatgatcttggctcactgcaacctctgtctcctgggttcaagcgattctcctccctcagcctcctgaagagttgggattacaggtgtgtgccaccatgcccggctaatttgggtatttttagtagagacagggttttgccatgttggccaagctggtcttgaactcctgacctcaagtaatccccctgcctcgacctcccaaagtgctgggattacagaagtgagctacaatgccagaccttgatttccattttataaaaagtctattctgactgttgtataaaaactgattgtagaggaacaagaaatgaaagaaagcagatacagagaaaattgtcagtgtctgggtagaagtttctggttgctagacctaggatagttctggtggagatgaaaagaagtggagtgattagaagaacatttggaagtggattgccattgctggttgacagaattgatgtgaatggtgagatcaagaatgaaattccgaatggtgctaggcttttggcttggaagttactggaagtctttaaaaaagaacagtcttattagtaagaaaacaaagcttgttccatttgaaatgccattagacatccaggtaaactattggataaataccctaaggggagtagtcattaccgtagatataaatgttgaggcttaacggcattgacactgaataaccctggaccagggtgagataaacatcaggaacagaaaacagaagagatctcaggattgagttgtgagtttttgcaacatttagaggttccacagcgaggaagaattggcaaagaaaattgagtaatagctgctagtcaggttgaaggaaaactaggaaccactccagccaagagaacctttaccaagaagagaaaccttaacgatgtgaaattttactgagagtaagaagaaagcaaagctgtggtctttccatttggtaatgtggaggctgccactgaccttgtcagaacagctttagtggagtttttaggctacatatatgatatgtgtgggttgaaaaaaaaatgaggtgaggaaatgaagacagcatgcacagatgatttttggagtgctgtgacaaagaacaagaagcccagttgtaggtggaggggcacatgggtcagagaggctgttggatatttttgtatgcaagtaagtgtgaaaagtgagaaatggatgctgcaaggtgggaggtggagtgctttgagaacaaagtccttgagtagatgagaagtggaatccagagtataagcaaagaggctgcctcagacaggaacagaggcttgtcttcctctgtaatgggagagaaggcgagagtgtaggcatggattcgggaaggtcagtatgtgacagtaggaggactgctgctgcctccccgtagttcgtgatctagaggagagagactcattgtacacagctcactacatgagtcagacagtggtctgagcagacagcaacaactgctgtgagagggcaccggtgggaggactctgcctaccaaagtttgacagtgcaggtggcatctgactttggcgttgaataatagatattattatcctgttatttgacttagacatcaacaggtataagggcatttcctctagaaggccgcttgcgaaagacctcgtatcaagaaagactaaggaagacatataggttgatctctttttccacagaaccctctcaggcatcagtgctttttcaaagccctgttctcctttgaaaacttcctctctccctttccttggctattttctaattatcttgcaaggctaagttgaagtgttcctcttccagaaaaccttcccagggcctacccccaaaccccttatcaatttgagttagattccttcctagatgtaggtggagcaaaaagatagtggcctctattttttggatgtgttggcatgagtgttggctttatccatctggtagaacaagaagcgtccatggtggtagccactcaagagctcaggcaaaatggtattctgagccccagagggctagattgaaggctgccaaaagagaacagtgtttgcaatcttggaaaaaatccttgttcatgtttccatggacacgtgcagttgagtccagctttgcacttcactttggtcaaagagtattttgatgtgtatcatgaaataaacatacaaataataaaaatcataaacaaaactctcagcatatgggtcagaaatcctactcagtttgtcatttatggtgggactcaagtactatcagcaccaactccacagcccagggatgaactttgttgtggtgtctgataggaaagttcaatcgaacaagctccccccaccatatctctataaaacagtcttatgctatgctatggaaaaggtttcagttatttgtctgaatatggtgggaggataatatcacctgcaccacagatacccatgccccaacccccagaacatgtgaatatgttatttgacatggcaagagggaattaagtttgtggatggaattaaggttgctaatcagttgacattgaaatggggagattatcctgcactacctgggtaaaattaatgtaattacaagggctcgtataagtaaaccagagaggcaagaaagtcagtgtcagagggacacagcatgaaaaggactcgactggccatttctggctctgaagacaaaaggtggctgcagatgaaggaatgtaggcaagaaaaggcaagaaaatagatacatcccctgcagtctccaaacggagcacagctctgctgatattttgattttagtccaatgagactagtttcagatgtctgacctgcaggactgcttttttgtgtgtgctgttttaagccataaattttgtgaacatttgttgcagcagcaatagtaaactaatatccagtgtgatgtacctctgtgcctgaatctgagactccatctaaaacccgtgcacagtcacagtgtataaatgggtgacaagatgaaaacatggcgggattcataagcaaaatgctgtgcctcagaacagtgccctttcagtaaggggatactaaatagatgacagtttttaaacagaacccctcagaacttcagtttcctcagcctgacatttggggtagtaacacatttctacattagaaggagatgtaagtaagataatgtgctatgaatggttttgtaaacatttataaatttccttgtaagatctctgcgatgattctaatactcttttgaagcactagaaagtacactggcctgagaaatgcaagagctgggttcaggtctcactttcaatgcctgtggcattcattacacaacccaatttatctttctgaagactccatttgctcatcactaaaatatggataaaaagatttagtcaactatgctaaaaggtaataataaaagtaaatgcacttttatttatttccactgtgtgtgcaaataattattaataaaatatgtcaccatacttacttctcattcttggtcaataaaacaatatccacaattccagctctcactgtacaaggtctctacatgagctacagtgagtgagtgagtgagtgataaggaagagggtgaatggcaggtgcaggaatgcccatataattggtgagctctttctccagccactgtgtccaggatctatgctcagatcttaagacaatccctgtagtcctcggtagaaagcctcttaggaatcactctttcatatttagatttattcctgggaaacttaaagctacctcaaacccagttcttttgctcagagttctcaacacaattctctgagttgtctagtgagtagaaatagaagccagaggttcatggaagtccataaacgcagtgtacatgttaagcgtttaagaaaatgctgtccgtcttgaaagcagatcaggaatctaagagtcagggtcattctctgtgactgcagtcaagatgagagcaaccaactggccctcacaggaagttttgggaggcagaaacttcattgattcatctaccttcagaatttcacatagcaccaggcacatagcaagtgaatgaatgttttatttaaaggaaatctgctcttttgaacaatataagtcttatttttttcaaagagatgtgtgttatcaaggaacttgatatgcccagaggttaaacttagttttctgactgccatttctatagtacaaaggctccagggtgctttctgtatggattagatgttaggcacacaactctcccaaacaaaactaaaaattgttccacaaatgtggaaagtatagaaaattaagtaatatatgcaaagtgatgagaatggtacacagaaaagagtgcaatgtgtttgtattatgctatgtgatctggcataggttcaattatattttcattgataattttcctataaatccatgctttggaaaatgacctgtctttgttttccctaaaggtaatgttatgcctgtatttgtgtatcttatcctagataaacaacaccagatgttgaaagagcataggaaggaccatgtgatatttatcttaagataatactagaagaagtgaggctattctagaacttaattgattcctgataaatctgagaaacaaaaattttgagtccttaagctattcatgatttccatttaagaaaaatttgtctctattttcttatttcccaaatatgttaattattgtaaaccaaatagaagcaataactgaattcttcattaataaagctgctttgtttaaatggctgtcgacatcttatattattatatagaatattatggtgacatagtcttatcaaaaaagagaacatttaatcacaaatttgtaaagcaactggattttgaaaatccatgaacattttgtacacaatagttgatgttaccttatgaaaaataaaaccttacatggttgttccattaaaagcccctgcttctaatacatagctattattttattttcattaaaaaatatggggacggaaacactgaaaatatcacttgaagataggcacagcctgtctggtttcttttatggtttttcagattccaaacggaagaaaaagatatataaacactacttccttgggtggcagatcaaataaaggacagttttgtttttgttttgttttgttttgttattcttgcaaaagctcttagtgaggtagaacaaaataaaagatggtttaaaacaagagaatcacatttatattgcttggctgtcttatttgtaggaaagaagataaattctttacagataggtaacagcactacccggtgctgactatttgagtgggatatatttccagttcattaaaataagcaaaggtgatttaaaaaccttcaacttcttgtacagtcacacttatcaacctaggttaattgggagaaaggccatatttctctctgaggtttaaaaaagtgttgtttcattcatttattcgctcactcattcattcaccccctcttcaaattcataaaacatcagttcgtgcaaggctatgattctaactaacgtactgaaaataacttaaggggccgggcacggtggctcacgcctgtaatcccagcacactgggaggtcagggtgggcagatcatgaggtcagaagttcgagaccagcctgaccaacatggtgaaaccccgtctctactaaaaatacaaaaattagccaggtgtggtggcacacatctgtaatcccagctactcaagaggttgaggcaggagaatcgcttgaacccgggaggcggaggttgcagtgagccaagatcacgccactgcactccagcctgggcaacagaacacgactccatctaaaaaaaaaaaaaaagtacaaaaattttctgggcgtggttgcatgcacctgtaatcccagctacacaggaggctgaggcaggagaattgttggaacctgggaggcagaggttgcagtgagctgagaccttgctacccctgcactccagcttgggtgacagagtgagactctgtccggaaaaaaaaaaaaaagaaaagaaaaaaaaataactcaagtaacaataactaagagtatatactaattatttaattcattaatcaatttgttcatttttattgcctattatgatgtataattccaagtttctcaaacctaaaccaaaaatatgaagcaaatttgtagtgcaacctggaagcttctctccctgcactctaattctgatatgttggtgcagctctgcttagttcaaacatgttctgggagctgaggtatttaatatagttcatgctttaaataccagataggttgggaaacactttcatttgaaaatttatgtgaatatataaactgatctgttaatacaccaatttatttatgcaaatgtgtatttgtggcccttaaagtcaattttcttaaatagaaatagttttaggcagtttatgtaaaacgttgattttctcatccatttgcacttacattaacttctgtatggtgacacaataaagatagctatttgttacttggtaggttagcacctgtcatcaatatttggagcactgcctataaaaccagacttagataagggtcaaggaagctatctacacttggtgcctacaatattaagtttttctgtatcaatctaatttccagattacatttctttttttttcatacagtttaacgtctgatgcccgctatctgtgttattgagagtgtgcatgtgtgtgtgtgtgcgtgtgtgtgtgtgtgtgtgtgtgtgtgtgttgccaggaagtagaataaaggactatattcgtatcagagcacttaggacatcactgtggagattggtttattccttcagcctcagtatccttatccgaaaaatgtacataattacacatagggttgtcataagggttaaagtcactctttttcaacaaatttttattgagcacctccttaatatcagacactattctaagtactggaaatacaacagtgaacaaaacaaaatattgcataaatgacaatgtgcattcttagcattgtgctaataaattaatcttcaattattagtgcaattggtgttgttgttgaggtagtggttggtagcagtagtagtagcagcagcagtggttcagtaatacttactgactcctgtaccagactggatatttcctgacacactgatatgaactcctaataaatagtgcctactaaatacctggcatggagaagagatgcacatatttgttgaattgaagcattgactatatgttttcatgcatatttttgtaattaacaaatgaaagaaaggcagaaagaggactaggatgaggaccatgtgatggaattactcagcctgcttatttctcacaaggaatgaggggatagggatataggaggagattggtggcatcgatgtctaatattatttggcaaataaatcaatgatgggttctaactctatctttacaacaaacctatgacgcaagaggaagagagaaagtaagtcgcatgcccgaagtcaagcagctagtactgcaatgaattcagaaaagaatcaggcctgttactctccgaaggcctttctctttctttatcctctgaagtaaagctgaggactgctttttgggtgaactaacacttaggagttgagagtttcagaaaaagggcttgcaatgtcatgtcctattgccactgaagaagaaaaaggcacaccaacttcacactcagctactccaagttcagtttcaattaaacataaagagacagctgggccgggcacgttggctcacacctgtaatcccagcactttgggaggccgaggtgggcggatcacgaggtcaggagttagagaccagcctggccaacatggtgaaaccccatctctactaaaaatacaaaaaattagccaggtgtggtgacaggcgcctgttcttccagctacttgggaggctgaggcaggagaaatcacttgaacccaggaagtggaggttgcggtgagccaagatcgcaccagcgcactccagcctggtgacagagtgagactctgtctcaaaaaaaaaaaaaaaaaaaaagacagctgtggtttcaggctggaaccactggagccagaggggcctctagaaaggcctggactccatggccagagggaaggagtttcacaaacaggattttgatagcactttagccaacagttctttggtgttctaatactgcttgagaatggttttgatgtctcataaggggttacatagtgagttatctgaaatcatttctgtctcaaactgtccagtctcccttacggtgctttagtcaactcttcgtcttctcagtcttcatgttaaaaggaaaaatcttagtgaaatctactacaggagaccagctaatttcttgaacaatagtgaccattttggtgagaggcctttaatagcggtattgagaaggcaaaccttcaattagaactgaaaaagttgtctttttttttagcaggaaactggtaaagggggtatctttgcacaaaagcagtcatatcagcaggagacattgtaaaattaaccagtcaagatacctttcaaaggtaactattaagaaagggaaaccatgtaacacccacctttcagcaattttttctgtaacattttattaagtatcttttcttaaacaaatgcaaagtgtattttacttcacataaatttgacattcatttcatcgttcattttgtgtctagtatgtaagaaattatattcaattctgttgaggatttagagaagagagagacacagcttatgccccacaggtacataaagtttagatacgaagacaattgatatacacccatcaaaatagtagtaatcaaaggaaaggaagaggaagaaacaggtatttcttgaagacctactgagtacctgccagatacttattattgttttcattttaaacaggaaacagaagtttagatgggttgtgacatttgcccacgttcacacaggtatagatttagagataagactcaaattcaattctgtctcctcccagagccagcactgtgttcactaagccccctgactcacacacatgacacagggatctggagatctctgctgaggtgttgaagctttgaggaagagatagcattttatacatgcattggagatcaagttgtaacaaatggaattttagtacatagttattccagatcatcatcttatggattgagggggtaaatgaaggagcatgtgagtcttccttggtttttccctgaagtatttgggaaactgaaggcaaaaaaaatccaaagtccaaagcgtgcgtaagagtcgttgccacttttgagagaataagtctgtagatacctttttacctccttcggtcaatgaataagtgctactgagtaaacttacattattttctattttacaaattacactatcaatattacttggaaatcctgttgcctatgtatttctacacagatcaaagcttttcctgtggtcggaatgctctgattgaatccacaaatcttactagttgaatcaaaatcaacggcttaaatgtcaggatctctatctgaggagctgtagacccctgttgaggttttttttgtgtgtgttgttgtttgtttgttttttaccaaagtcccccgaaagatgaagagggcattgtcttgtaaaaggagggacgtgggaagatctgactagaagaaaaacatgtgtcataaaaattactgaatgctattagactatataaaagtcagttcttaaaagtcccttagcaaaaaagcacatttgtggacaacaagctgttcactttgattgatgtgtgatatacacataggagtatgtgttagattaactggaggcacattagggaggacatgaatgtcaggatgaagaagttggagtaactgggaataatttgattattttgagcagagaagataatcattgcagctgtgctttagaaagaccatctgtgagtcatgtgtaggacggattatagaaaagagtgaagacacagcaaccagccaggagactgttgtaaaccttcaagcaaagatagcaaaatttcagattaaatcagtggtgatgaaaaagaagagcttgagttggattctaataaatactcattggaaatgagtattccatttccatgtaaatggacagtaggctacaagtagcggataaagcagaagaaagcatcaaacacgcctcctagtacttgagcttgagaaattcagcttggtttgagtttgcatatagtgaatatttaaaaataaaagtagcttgtactctttcacataggaattacaggatgtagtcactatggaaggtcagttcactgtcttttaagaggcttctctcagtagcattgctttttctggtgaattcagcataaagactaggcttagaaattgactttgtctggaaattaaaggcatatcattttttcaggggtgacttcacattaaaaactatcataagacatataaaattagaatgcaaaattagtacattataataaaaaataattaatggccgaatatgaatatgtttagcttccattcttactttaagcataccttcatgggaaattacatcacataaatcaaaaacaggatgttctttgatgaacaaggaatcaacaatgaaagttggatgggtcaaatatttaacaacagccaggaacatccatctgccaacagaaattctgtttttaaaaacagaatatttagcattctctaatgcagtctactgcattaagtcaggtttgcatgataacctgacttttcattatgacttttttttggttctttatttaactgaccatcagatttaatatgttaatgaatgtaaataaaatgcatcaagagtatagtaaattcttttgagagtgggcagttttctaactctttaaggtatcattttgtatcttgattcattaaagttgactgtacaatttaattctgagtacagtggtgtcttttattttgcaatctacctcactgtataacccacatattaacaggagctttatagaatctgaggggctggcaggatataaagatatacattaatcaaggcaactattgttagtttgtagtaaatagtcctaaaataccactgtcttactacaacaaaggtttctttcttatacttatcacagtctaatgagggtttgttagttctccattgactctctcccattcttcacctaggggtgttcctggaggctgccctgattagctctcatcagtgggctcctttgccctctaacttctgatttggctcagtcagtggaggacaaccactgtatatgactgaagagcaagagaggggatttagctgcagtgtttatttctgcagtgtttcctttactggcagcatgttcctattaaaaggaaattctccagtcaagtggcattcgctgtacaactctctctgtgttctggaatctagtttcttcatttgttttctcaggcctaggagtagtaatatctctccaccattactagccctgggggtattacatcattcttcattgctaggtataaaatttgtcctcacctatataagagatgtcctgtaaatctcttctcaatttctcaacttgggtgtgccatatgctgtctacttgaactttgacatgtattctcaaaacagtgaagtggctatttaagctccttctttcttgtgatgctatcattttaaacacatgctctctaaggttgctgcagaagtggagacagagtgaggatgtttgcacaaggttttgtgcttagtcctaaacatggaagacattgctgcctatatgtcacatggctccaacataactgaagtggggttttctcatagactcagacaagttgggaaataatgggatttggtgagcatttggtattgtttgtgtcgtacatggagatatgcaataagcaaatggaaatgtggacattaactcaaaaggaaggatgatattaaatacataggagaactttagatggcacttgaatgttataccaattcaaccccatcatcagttttgaccacatctttccatttcttaaacatacttcgttcccactacagatgccatcttggttccttctctacctctattttgatattcacatagaccagtactacagatttcagttatgtggttcttctgggttccatctgtttcttttcattgtaactaacagaagcctggtctgatttgctaggtgaagctgtacaagtgaaagagaaatgttggagagatgtttcatggagaaaagatagccagacagactccagattacgtccacgaatatagaagcaagaagagaactcagtaagaggtatatgaatcaggctcagtaagaggtatatgaatcaggacaatatcatcaaagacagtccaggaaggaggttcaaaaaagaagacatggacagaagtaccaaattcagggatatgtgagaggacatgtggaaaagagctctggatattcatgctcacagtcttcaccaatagtggactgaaggaaaagatgtcattgaaggctgtacagccaccacaaagaggagggagtttcagtgcaaagagggcatgcatttctttcatcttcatccttacttctttccgaacttcaattctttgaacagtctacttgctacctgcctgaatcctttcttaatcttcttcacatgtactccttcaactccagaaataggttttctgccttttctttgttaggatcacatttcatttatgttctttaatccaagtcagttcccaatcattgcttaacaagacttggcttcttattgattctctagttcagttgcaatggtctattccaaatcttctccaaacaccttaagctgccatccaccatataggccttactcaatgatgctctacttttcttccttctacctaagacaactttgctttgacacctctgtaggcctaagaaagtggcctgcaaatatgttgctattcactcttctcacctcccaaaataccaccttaatctctcctgcttaatttgcatcttcaaatatttagtttctctcttattgcttacccctttgtctcaggatctaagaacaggtttagaacagataactgaaatctccatgacctcctttagataatacctttggtctcttccccaccagagtctgacaatttactaaacaaatgaccgttctcattggtttaatagccagttcttttcattttcccctgctgcccctctgcaggaattactaataagctgcagacttgggcagtagcaggcagtagggatggctagaggtgaacagtggcaggcagacccttctgatcctcaagcagcctgcctggaagtgagcatgttgcaggaatagtagtgttatctcttgagatagatttctcttgtgtcttctaatctccccccaatgccagtgttatgtgtgtgaaccacccttgaaaaccatcttctgctttccatttggctttccctttgggctggctgtaatatttgcttgctttcctatgtcaggactctttgaatgtatacctgtatcttgtagctatctcagggacctttacaccaagctacatattaaaatagttttctctatttagtaattctatgtttcttctttatcaggatattccttctcacttttatccccaaaatggaagaaataacacgttttaaaaattaattgcatagcacatttgcaagttatgttcccgtacttagtccagtttaagcctcacgccaaacttatgaggttgatattcttacttctatggtacagacaaattaattgaggcaagaagcagctcaggcccttgtctagttgactgctgtgactcatactttctgttcttggctgctgagtcccttgctccacatttctgctttcctaattgtttttgacacaaggaaatgagaacatgttggaaaaacaatagtctttctggatgagttgttgggctaagtgacctttaaggtatgttctaatctagaggtctttggttcttgcttgattatagtgcagtactattagacaatcaatgcaattgtcctagctgaatgacagggtagcagagacagtgaaatattatttttggcacttttttagtgttatctatttttgtcgatagaaaaataaatcccaaaatccaaagggaaaatatatatttatttgcacttagtgttcagtagtgaagtgcacgggtcatttgttagtggatgaatgtgggcaagttactttacctgtccatgatataactccttatgcataacgtgggatgaataacatgtctactcatagagtttttctgaggttcaaattagtgtacacatgtaaagtgtttataatggtgcctagcacttagtaagtcatcagttaatatcagctgctgttacattttgtaaaaatagtaaagccgtgtgtagcggtccgttctcacgctgctatgaagaaatacccaagcctggctaatttataaaggaaagaggtttaattgactcacaattccacatggctgggaaggctcaggaaacacacaatcatggcgaaaggggaagcgggcatagaccttcttcatatggtggcaggaaagagaagagtgaatgagtgaagggggaagagccccttataaaaccattggatctcatgagaagtcactagcacaagaacggcatggggagaaactgcccccatgattcaattacctccacctggtgtctcccttgacagtggggattatggggattacaatttaagatgagattttggttgggcacacagccaaaccatattactgtgtaaagaacttaccacttttaagaatagttaatattaattgacatacagtatctgaccatttattacttggaaaactctatctgcactatctcatttgacctaaattatcaggtagaaacaattatgatcacaatttaaaagatgagaaaactgaaatatagggaagttttttaacttaagtctcatcgatataaattatatgaaatgatttaaaaaggtgtgtctgaggagaggcagcataactaattagcataactaatatgcgaagcctttctggactcagttttggactatgtaacaattacacaaaattggaagccttttaaatgcctttgggaataataaataaagagttgcacctggatttcatttttaccgtaatcaaatgttttatattaggtattttggaaaactactggaatgaccagcaagattataataataattctggagccactttactattattgtctcatttatacctctcagcagaggctggagcacatggggactatgccattcccataaccatatgttttaccaccttgctctttgtcctgtagatgagcaagcaaagaagcatacaaagagcatcctataaaagagcacgaacaaagacaatgtttgaggagctctgttctttggtcttcccagagtaaatatcagcaatagtaggaaaaagtgtttaaaacacgtatgaggggaaaaaaaaaaactacaggaacgtcaattacaaatgattattttcaaaaataaaaccttctagcttttaactagtttatcgcagagctaaaccaatacagtttcatgcctcataacaatttaataaatattactaaaatatggcaactgctaccatggctcattagcaagctgttggtgtaatataaagttatccagaattgttttgggtagttggtttgtcaatataatgcacacagtaatctctgaagaaagtcaggaacatatggtccatgttcatcagctaaccccaggggactgcaccagaatctctcttcttacaactacatgacgttgagaggagagcttgagagaagatagggaaaaaaagaatgggtggaaagagaaacattgattactcaaaccataaaatcacacttgcaagcataaatcaagaatcacaaagctaacatcttcaaggaatctgttaaaatacaagttgaacattgtagcatcagaaattctcagaatatgaattctgaatcttgcttggcacacagctaaagttaatcatttcagcagcagcagtaaaatgctgcatatagcatgctactggccaacataaatgaatctaatgccatctatttaccaaaatcaagattcctttgaatatattttcaataatttatatgctaagatgtacatacatattacactctctctctcaaaagaaacgtcatattttctaatttaaagagacatatcttgtccaattaaattcgtttgagtaggaaactgtagagttaacaactgtcaatgatcatctatgtataagtagaattatacactttaaagattatgtttatttaataaccatccctatttcctgtaactgggcaatcagacatttttttgacccaaaatatgaccactgcattttgataactctaacagcacaagatgaggtctggctattagagccatataatgatgggtaagtattttgttttcttgggtgctttcacagtgtaaatattatctcagaagtgggtttttagggcaattcaagtaggatgcttaggaatgtacttttctttatttggaaaattttctcagatttcatttgctcagttttatacctattgatctttcattttaattttatctaaaaacctttcagttttgcagtgtgtcacaagtctgtgtaagctgcagcttcagccatctcttccatgcaatgtcaatcttgggtcgtgtgaagcatgtggctttttggaaattttctaagtaatgtaattgatgcaaaaaaatcaaggatatatattttcaatagccaagataatagatacataatcctttcaattaaaatttgtgttaattcaaggaagggtaggatcagcatatatattatgtgtttatcaagaatactctcctgagaaaattcatgaaatgagaagtaacagggagaaagttgaaacattgctataacatatcaaaatgagaggctctgcataaatgaatttataagaaaacattaaaattgccaagtataaagactttacagatacagagttaatattacctttatgtagacatttgaggcttggccaggctctcctcaatgagtctattttaaggtaaagttattaaagtccggctcccatctcacagatattatttgaagttgttttatgtggaagcagcctgcctcatgtgattgcactgtgaagctctccagctagaaggcggctatgtgacttgaaatttaaatataaagcaaattcagtcaggtgccaaggtgccagcctgctggaccaccatattgggaggaaggagaagtggagggcagggggttgaatggagattgggttgtgcgaaagagaagatttcaaactttggggctggaagagcacagggtgctgcaagaagcaatgtgttgggctgaataattcatgatgcagtactaattttgactctggagaaaattgctttctcactgtgccaaaagctaggcagtgagaccaaaaatcaaagaggaagctaaatggaggggagaaaacaccctaaatcaacaccatatcaaattgacaaactgtttaaggctgcaaaatgtattgtcaaaacatgtgagtagatattttaaaccttacctaaaattgagcatatttatgcctacttattttgagcaataataggtagatattaaataattattttcaaaagtagctccttgatattaatgcagagagttccagtaaggaagtaagcatttgcatttcattggaacttggtaaaaaaaaaaaaaaaggctgcatatcttggtatagtgtaagagatccatcatcattttgtacttacagaatcatatgggtgccagaaatgaccttttgagctaattaacagagctgccataaatatggaacttgataaatgttaatatttattggattcctaaaatccagatggtcttccttgtcttttcattctctttggaagataatattaaaataagaaccttctaaaatgcaaccttaggcatcttttcaaagtctcatttaattcttttctttaatggttaggaggacttatgagcatttctgaggaaaagtcgctgactgcctcttaagccttaaccaagctttaaactttagggatttccactcagatttaacaacattgagaattttggtcctagatttctttttctttaaagagttctttaaagagttaaagaaacttctgggcaggaaaatacaggaagcttagaatgaagatggttgaggtgttgtcttcctcctcttctttcattttgtttgttttgctttcaagagaaaagccagatacagctctggggagtcgaaaggcatccttggcaaagaatgcaatccctccagaggctgaataagcgtgcacaggatgaactcacagatagccacgccagtctcccagagcagagctgcatttccaaaaattcactttctggcaaagatgaggattttcctgtagtggtttgcattgctgaatggggctgaagaaacaccagtcttcaggactatttggaaattatagttaacaaaatctagagagccatgagcaatccaaagtaaaattcagttgagtgtgtagagccttccacatgagagggcatggtatgtaatttgcttcacttaatacagattttggagacagggcagcaggctggtgcacagggcatattttagagggaccataacacacccctatactagaaatgcagtgtactgtgtctcctcactagaaacctaaatacagcctctgaaaggcttgtcccttgggtgacaaagattgctgaggtttgatggagtgctgtgctctcagtatggagtagggggtggtggaaacaggaggcatatattttagttctaggacctccctacatttacgagttctttgactttggaccaagtcatttcagtttgcttggctttcttttcctcatatgtaaaatgatcattttatgttagtttgaaccatgggaaatagctgatatttgactaacctataaaaacagcaatttcacatggttcaaactaataaatgctcttgagacttgttctgaggagcaaagaagcacctcgttgtagataaacacatgcatgtaaattgtgtcctcttcctgctccagttacatcatctattgaacattttgtggagtttcaatgagataatatttggaaagcaaatagtagcactcaataaaagtcagtttctctcatcatgattccacacactttaatttcaactactgttttgaacttaacacttctccagtgttttacaatttacaaagtgctttcgcataagttaactgtttatgtgatttttgcaacccagtgataagacaatgaaagttccaaaaaagttgtcacttggactgaattatccagataggtagtaggatattgcacgtcgctgagtacaacatatggtcattgcccaataccgatgtctctaaattaataaaggcaaagtgggcatgtaggcatgtcactatctagtctactaatcagaaacagatcagtggtctttaaatattttgatcacacaactttttatgtgataatatttgaaacattaatatatgtgccatttatctatttagtatacattttcagtctctataaattatatatgcatggcagatgtaacatctgatgtgcattatgaaacatacgtaagtaaaaccttttaaaggaaaatatttaaaaagtaaatatattgcaagtcctaatattttctccctgcattccaaaggattgcacaattgcagctttttaaattgagatgcaattagcacagactggtggatttctatggtctttattgcccaggccctactttcggttcccaggaacaagaaagttttgggatttgtgatcaagtcagaccagcttccaagcttagtgaagctagaacataagcatgcagcttataagggaggacccaggtagagtggtaatgagagccttacttgtagtcagagcacttactatccaaaactgtggcctcatgcagggcacaagcaccctcaacctcaatttctaatacgggtttatttgaggagtagaaaagaataaaatacaggttgaacatctgtaatctgaaaatctaaatctgaaatttttcaaaactataaactttttgagttctggcatgatatcacaagttgaaaatcccacatctgacctcatagtcaaaacacagtcaaaactttgtttcatgcacaataaatattacataaaattatcttctagattttgtgtataaggtggatatgaaacaaaagtgaattctgtgtttagacttcagtctcatcctcaagatattatgtatgtgtatatattccaaaattcaaaaggaaatccaaaatctgaaacacttgtactctgaagcatgttagataaatgatatggaacctcaacctgtattctattgaaagcacttgctaatctataatatactataaaatataaggtattatcaatgtgtttatgtttactgtgtatcccagcattttaaatactgtaggcacacagcatgagtttaatgaatgaatgagcaaaaacattaattaattaaaaataatacattaccttactatgtcacatatgctatttccagaaacagaagacacaacaaaatatgttttcaaagcaagtttttttgttttgttatcattttatataataggaatctggaggtaagtagcaccagagtcggcttattcgactgctcaaacccattggtaagaaccctggttctgtctgtcttccactgagccacgtggaggcactgggctctttctctttggctagatctactgaatttctcagacgctgccacagttccaagcagctatgaagatggcagtgtctggaggcattggaaagggaacattctgttctgacaaagtgtttttttaaaagaaaagaggccaaatattcactgagactcccttccccttaggctcagtggctggtagtatgtcgtagcccattatttcactagtccaggacaaaagcaatgatgctaataggatttctttatcttgagtttcatgtcttagggttggagaagggaccaagcctcccctgaaagctgaggggtttatggtcaagaagaaagagtaactatggccacctttaggtcaccagccaataatactgcttctctatcctgttctgctgtgacatttgtcccagcaggtgttccagtctgtcctacagtagtgagaccacctgatatggtgaggaaggcaggtaattgatcttactccatcatatcatcacatctatttccaccccccgcccttggagacaaggtctcactccatcatttaggccggaatgcagtggtgcaatcatagctcattgtagtctcaaacacctgggcccaagtgatcctcactgtagtctcccaagtagctaggactacaggcacatgccaccacacctggctaattaaaaaaaattttttttgcacagagatgggggtcttgatatgttgcccaggctggtctggaactcctggccacaagtgatcctcccacctcagcctcccaaagcactgggattactgttgtgagccaccatgaccagccccatcacttcttttgtaggtttgtatttgtttttatttttgacaaagacttttatttcacggtgacttcttcacaagtttcctcagatgctagtctgaacaaaggagagcagggaactagaaatgtagactttctgttttttccagctatggcatcactgatctcatccatcttactaaagtttgtgcagtcttgatcattccccattcccccaacatgatggcaaataccagttaagtactcatatctaaagaaatcctttattaacaggaagttaattaagaacatgtacatctctgacattcatcattacaatgagtagaaattaattttttcaatttcagttaaattttattcagcaaaaagctttaacctcttataataagatgtgaagaattatgagaaattatttgctgtatttctggaacgaatgcatttaataataggtcagatgagcaaaaatggttgtaattcaaatttgaatagagaatttcttcggtgatagcaaatggaacaatatggcttttataagtaatattttgattttaaattatttaaaatattcagatgctattctagttttaatccactttttgctttctttcccagcatcctctgaaagtttatatgctagaggtctctccttcagccactccttgatcatctccaattagaaatctatttatttttcatcagaaatgatcaatgctacaagtctgattaatatgagtggtgtgtatatgtgtgtgtgtgcacatgaattttagacagttttctgcagaatcatcttctgttactatttttcaagacaatactatgacaagccaatgtgttctgaataaattatgcaatcgatgggtgaagcaggcatttgctttccagtattatacatcccaacttgtatcacacaggcagacttctgttgacaacactattgacctatatatgaaactttgaaactctgttttacatttacaaaatttgatatttctgatattctatgggcttcactttttgacatcatgcctttgtacttttatgcaatttgataattatattcagccctttataaatagttaaaataatgtttaatcatctatggtaaatgtgtaaattccttactacacactttctgattttgtgtgtgatttgtcaggaaaaattcgtggtttgtttatattttttatgttttccttttttttttttttttttttttgagacagaatttctctcttttgcccaggctggagtgcaatggcgcgatctcggctcactgcaacctccgcctcccaggttcaagcgattctcctgcctcagcctcccaagtagagtagctaggattacaggcacacactgcacactgccactactggctaatttttggtatttttagcagagacagggtttcaccatgttggccaggctggtcttgaactcctgacctcaggtgatccacctgcctcggcctcccaaagtgctgggattacatgcacgaaccactgcgcctggcctttttttttatgttttctacacaagaccagattatattttttagaactaaggaaaaggagcacttagaaagtgtggaaaatcaatgaccttgcaatttgatatatactctggagtatactctgaaatctcaatagtttacagacaagatagtagaaattagaaaatacattttatatatatgtgtgtgtgtgtgtgtgtgtgtatgtgtctctatctatacatatacacacacatatatgcacatatatgtgtgtgtgtacacatatgtatacatatgtatgtatatatctgggtgtgtgtgtgtgtgtgtgtgtatagatatatatagatatatatatatatatacccttgtgctaagggatatattttctaatatgtattcatgtatttttataaatcttaaattttcttcagtctcatagctacagactctgtaatgttttttgttaaactgaaaataatcatctctggtgaatctttctaaactgtgtatttctaaatgtttttaccagtattattgtgtttttggaatcacattactttttagtgtagtgatagcaagtatagcgagttaatgctttttttaaattagcaaattaatgtgaagatcagatctcaaatatcaggttgtctgatcttattcagtatgccatttggcttaagaagttctcattttgtttctgcagttcactcatactgagcaaatctagacaaaacaaatcctgttgctcacttggaatttagataattgtttcacaattcaaagaaagaagttaattagcatgactttttttcaattaaaagttatttattaaattttctttcctgaaactgttcatttcctaggaaggtctagaatggaacaaatataaaactaagaaacagcagcttttactccatgtgacaaggttttgttgagggtgcctgtggggctggccatatttgtcatgtgtgtaatgtggctgtgcctctggcaagctgtaagctggtagttagtgtggagtctgcattccagctacctgggtgccatcgctcttaacacacttcttagctcagatgttccaatatttgttctcctgacctacaacattaggaccacgtgggaacttgctagattctgaggctccctcccagactttctaaattagatactctgagggtgaggcccagaatctgtgttttaatgtgctcttgaggttattctgattccacctaatgcttgagaagcactgccctagcttctgtcttgggcaacactcctgaatcagtgcctagcttttcccagctgtaaaatgtaaaatacaacatttttctcgtagaattattgtgataattcaagaaaatcatgtaaagttatttctgcaatagttgcctaacagatagagtgctctaaggacactgagcgttcttcaaaagcagtatggcctgtgtgctcccatgtctgagcacatttgaaaaccagcctctaaaattacacttcctcctctatcaatgattgcagaatcgaatgttgcaaatgcatggcagtaatacatcctttgaagaatgaagtgttattaaaatttcattccataatatttgtattagttttgtattactcaaaaggcctatcttattttactttcttaatgaaattaatttttatttcactatgaatatttttttctagcccctactttcatttccaaattttctcattttctttttagtctggatatttcctagataatttatttcaacattctagtactgtataatctcaaatacccaaagaaaatacattttttgaaatattgatgaactaaaaccaataggtatgaatgagtcgatcctgtgtttaatctacatgtgagatatcacctattctattccatgcaaataggaaggtaaatatgatgaagtcattaataataacgaaataaggctattttatataagaatttaggttatgtcccatacaaattaacagcataatattacgtgattagtcttcctgatactaatattttcctaatttattcttttcaccagctgcattaaaattcaccgcaaagattcagtccaaggttctcacagggaactaaaggttaaaatgtgtttgttagccaatatacaagactctgtaatcttatatactacattggcagggactgttgggattcagttctgttcagccatggaggacacactctgtgttgccctgagactgtggaaaatacagcgtctataacatatccccttcttacagaggtatgcatctttgaactcagaactctcctttgctactctcattcaagacactgtacagcccagaacttccagcctgtgggtttttctcaccccctttctctgcctgagccctctgctcagggtgggattttcatgatctccccacatatctttcttcttctgtctctgcttttcctctcttcccaaagctagaaagccatctcctagcttaattaccacctcccatgatcttgtctatttgttgctattaatctgaccttaataaaagtgtttcctgagatttcaccttatggacatttggattcaaagtaagggctagaaatggagagttagacgaaggatagatgagctgattgcatctagggaagtcaaggagttgggcttgcattgcagagaatggctaagaaaggagaccaatctatgggatacttaaaaaacctattaaatctgaatatctgagtttgtccattattagaattctttcactaagtgcttcttaaaatgatcaaagaaacgtttgggattgtgagaaaaacagaaacattgtcctgtgcatatattaagtgtgctatatcaaataatatttcatctttagccatcagtaacacatttgttcttagtatatatatgtcaatctaaaaagggtttctcaaccttaacattattaaatttttaggttaaatattgttttgtttgggtgtgggccgccctggcattgcagcttctctagcctctacatactagatgctggtagctatgtgacccctcaaaaaaattttttggcaataaaaaatatcttcagacattgtcagatgtcttctggggggcgtagtcatccaaactcgagattcgctggtccagactgtaaaaattatcaaactactcttgggaaagatgaatctattttaagatccacttgcaagctacatctacataaatgtccattaacctttagtactttgtgacctgattttgtgtttcttcttgcatgattattttttgggccctcaatatatatttgttaattctatttcttcagtttctctagatgctttatctggccaaatagtgtatcatagcaaattagttctagaacctcacttgtcttaatattagttaattggaattaatatttgttaattctatttctttcatttttctagatgccttatctcgccaaatagtgtatcctggcaaattagttctagattctcaatagtcttattattcgtaggtacacaatagtccaatgcattaaaatgactttccttttaatagttctacgtgaataaaaatgtatttcctggcaaatttcacctcaatgctgcaaatccattgaaaaagggaataatacagtatcacgatacagggagaaaaacttagaaacacaataagatatacatacacacaactttacgagagtaaataataagtaaagatatatatgtatacacacacacatatactgatacagatcactgcaagaaaatcacaaataccaaagtcaaccagaagacgtgagtagagaaaaatagacaacaaaacaacaaataatgcaaattaaagtgagataatcattttgctgtcaagataggagaaaaaccaagagtgggaagatattatgattcttcaatcatgtgggcatgtatctttactgtgtgtgtgtgtgtgtgtgtgtgtttatctgctgagggcctttgaatactctttccttgctcagaacaaatagacaaatatataattaaggcacctaacaatacagaccatattttcagggatatagcaactaaaaggtcttaggaaggccaactcaaatccaagcacatggattccagctggggacaggagtgaaaggagtggatttcttgtgtctgtgagcctagagtgaaaaacagcttcaggaaaccttcactttgttatgtatgggatgaaattgaaatcaagtgtattgtgttagggggatcctacaggaagaagatctgggagatttttcttgaggtttgggggcaggcatttagctgagggtggacattgaggagaatctggagggcttttattagaaatatgcttccataccttgcaaaaaactccaaaatatcacacctgtttctcaataccacatgctttgtacatgccatataactatttttgattaccaaatttcattttgagttttgatactagttttaaaattacagttatagctgagcatcatagcctgtagtcctagctactagggagacagaggcaagaggcttacaacacaagcctggacaacatagtgaaatcctatctctacaaaaaaatatttaaaaattagtcaggaatgatgacttgtgcttgcagttccagctgcttcagaggattgcttgagcccaggagttggatgctgcagtgagctatgatcataccatcacatgccagcctgggtgacagaagaagacactattgtctcaaaaaataaaacaacagttgttcaggatcattaggaatatatttaatcaatgctttttcagaaatggtggtttaaaaataagtaggctaggaaggaagtcctaagtaggtattctggtctcagacttgtgcttcctgcaacacctttaatatctataaaataattagagtttttgattgtggagtaggcttgatttggaactgaggatttttttctagacatatattttaatttgagtttcactcactgccaaaaaaaaaaattggcaagacagagaaagaggaaaaaaaaaaaacaggccacaaaatgtaaaagtcaaaagcagtcattccaaatttgtgtcttatatattctctcagactttgctgtcttctttatgtttcaacatttttcagatagcatcattaatgaacagccttccagcccccctccataatgcagctttttgatcctagtgcccaactggcttcaatcaattcctctgaccatgcagtttatgactctacaaaacctgccaggactcgtttccttagtattagatgcaggcaggtagaaattgagagatgattccacataatgctcatcaaagcagaaaaaaatcaaacctaatgcacaacagggttacaaagagaaaaagttaagcagtctgtattaaaaacaaaaggaaataacagggacagaagaaaaagagaaaataaaacaagtgatttcatgtaggtgctatagaatctttaaccaaaccacaggctctgatgaatgatctcttctgcctgagactcaggactgtcatggtccttatgtccaggaaaagagccagctcttttattgagttgccaagagttgtcactgaagccatcctgaagtttccttgcttctagttagataggaagagaaacacaaatacattctccctcgggacggacacttccaaactaaccactcccatccagtggtaacctactcccaaatcctccaggtggcctactacaccctgctttcttctgcttgcagttgcctgacatgacattgctcaccctttcttcttgtaagtgttacctttttctgtgtccctttgttatagatgtttggcctatagtggaagggccttacatttgtgtcacataaatcatgtcatgttattcagcccattacattttatgtcaagtaataccttatggtattttacctttatcaatataaaacaaatttcttttgttttaagtttttgccctaaacttcaatattatctggtgatggagtggtaaacaggctcttcattcatggagcttataatctagtgtgagtaatagaatagaacaatttcttaaataaatcaggagttaacgccgattgtgatgagaactcaggagaagtgtaaggtatgttggaaacaaggagcataagttggatgagcgatttagacaagtattccatatgggacagacagttctgcctgtctgaaggacacaaaggatgtaccaaggttatgtttctagacccagttgattagacccctgggtttctgctcttgagacattgccagaggccaaattaggccaagtccctgggtgtgtttgcctcctgtagggcatttctaaaaccaattactaccttcagatcaagaacattttctcttataacatctcttgaattgtttgggttctccttttaagaataacaagtcatccctgcaagctctttattttctgttctctgtatccaccgtgttttccctatttttgtttctttgttcttttcttctgaattctaggtagacttaagttggtcttccaaattgttggcatcaatctggctcttcagtgccccaatgtggatttctagtatgattttccgtggtaattttctgtatgtcacatatactttttacatcctaatatgtggctttattttcctgtcctgttctcttcattttgcttttggctagcttgtatagaaacatgttatttttgcatttgtatggaagtcatgttgcttttgaattgtaacaaaattgaaattttcttctggatcctgcagtagattagcagaaaatcttctttttgagaaacttaagtatttcctctcaggatttcttcagttagcaattcactaggaaacagaacccgaaacaattctttcagtgtagattctttattgaaaggcaatgcatgggacagccagaacaaccctgtctactccaaaggggagaacagtcagacgtgcctgcagccagccccagcagctgcagctggaatgccggagagccaaccaagggtctagaacatggataaagctgagataatctcagggtgtgtgtgttactttgaatgtatcagagtacttaatttctcaaaaaaacatatcacaagacaggctgtctgttcatataggtaatagtctgcaccctagatctgtatttggaagaagcttttctacaactgcaggccaattgctattcctggtgggtatttactaactcacttctgcttcaccttggccgcttttccccctggcctatcaactcagttggagagaatcagaactggacattttgaacaatggaaaaaattgatttcctcctaaatatactactagggtttttgctgcctttgtgcactcagaatgcagtgtagtaatattccagcaaccaccccaaacacacacacacacacacacacacacacacacacacacacatacacaccacccacgttcttctggatgccccactaacatatacaggcacacacttcacagacacacactccacgtgttctgcctaatttcttggtattcttttctcttataaatgtagtcaactagcaggagggcaggaataccaaggaaaaggaaccagaattctggcgcttccagaaagcagcaccttagggctataggcacagctattattttttggccagatcacaacctgtaagagatacaaagtgagtctgtttccttttctacataacctctgtcttatcatgacagaaaatgttgccggattctgggccaaagtatgaaacagcatcagaaaagccagttgtgtcatctatccagggatgccaccatgtgagaacaaggtcccctaatattctagagtgcctggcctccatgcagggacaattgtgtatttatttacaagaatgtgagcaccaacactgcagagtttaggcatttatgttcattgccgtatcctcagcacttacaacagagcctggattctaggaggtggctaatactttattttggtgaaatatttgattagagcagttatgtgattattggctgtcttcccctagactaggagttccctgaaggcagcactatactcttttctttgccaggttatcttctgcttcaggtacagcatctagaacataaaaagtaaatacatatcattttatgaataaaaaagcacttttagaatgcagaaagcagaatgactagtagtatagctgtgttcatgtctgcccctcaaataaactaagtgacctgacgatagtgactcttgtattcatctttgaacttctgacaaacccagcacaattcttttaagtaagtccttgcttactaattatttggttgaataagcaaacaaatggaaacatccataatattagcaaatatgatgcaagacatgaaaagccttatgcattgaaatctacatgacttaaccctagaaggctgaagtgataccacaccaggaaaattactaacttaacagaacacatcaaaataaaacattgttcaaatctatataattatctcaattgccaaaaaagtatctgataaaaattcaatagctattcatcataagcacagtaaaaatcataggaaagagggtttcttttttcacaggggaaaaattaaatgtttcaacaagcattacctttaatgtagaaatatgagactttctaaaacaaacaagaataatatgaacatagctcactttaccattgctgctacaattatttattattttaatagtaaaattattaaatattaaggaaaagaatattaaaaataaaatcaccagacctcacaatattcagtatacttttaaaaatgaacttgcaggaaaattgttgtttcaaatgtgtttactaggaagaaaaaaatgcaattatgtaggattatgattaagaccacaaaagataagtaaaaatgatacattaaatgctaatgtggggaaatagaagacaaaagagatgcatgttaaaaaattacaagttctaactacggtattaacacctaaaatcagttgaatatcatttgcaaggaaagaatatcgtttctttaaaaaacatatgctactttttctgttattaccactagaagctacattaattagacactgacatataataggatagactctaagtataaattatttctcatgcacatagcaccttgattggtagatattattgtcttctttcttccaggtaaaagtagagggtgagaggatgctcagcaggtggaggaaatataccaagccagggcacaggtttggttctgaatgaagggcatgttaccctacaacagtatgaacaagaaaacatgagtaacacaaaagcactagatgaacatatacacaagcgaacatcctcacacacaaacatctagtacaaataattaaactcagagtaattatcagtgtgattatgagaaagagataactcatgtcccacacagatgtaattaactatgtgcaaggcattgagtaaggtcttaggatattcctcaggtttggaatccccttcctgcattttcacttgttaaaataaaatcaccaaggaatatttacagtggaatatttgagagaaagtttgtatatagtttatttagtgttatttgtgttttaattctactttagtgttttgttgaagtatattaagatcacgtggcatatttctgtcataatgtcatttagtaagctctctccatacccgtttcttctacgttattaattttcttgtcgagacttgtattacttttttattgttgtttgttccacttaaaatagggccattttagtatctccaaaaacaatactatttctaattttcttacattttaccccaagaatctatccatatattactcaaaaaattgaaaaaaggcaaacttccaaacaacatgttaaggaaataaacacacttcagcatccagttttccctaaaggagaagcaattactcctgggatactaaatgagatttgtctgtggctcctctttgagaccagttttcctcaccagggatgacttattcatttgtacatcaaggaattctcagctttcttaccacttctagaagctggggacatttgatcatgtgtaggactccttacatttctgaaacacatctcagaaaagcaggtatagctaagccaacattttagaagtgcagaaaggcattttctggaggcacaccctccaatgctgcttttggagtccttgtgagattttgatttgaatcctccttctgtacctattagctatttgaacactgatgaggtactaaacctctatgaaccctaagtttttgtttattatattaaaaataatgctagcccttatatcctagaattgtgaggataattattagcaggtcatatgatagcaaatattgactgggttcttaacacacttcaggcattgtgcatgctatatgtttgaatccatctttgtatttaatgctaaccactctatgaaatagttgttatttatctccatttataactaggaaactgagattcaaattgctcatgtaatttggccaaagtctcacagttagttgtccagattcaaattccccatctattggactcatagtctctatacttccaggatggttttcacacctattcagtgctcaataattgtcagtcatcactgttgttattattgggagaactttgaaacacatttcccagaaactctcaattgacaaatgtggagccaagtctcttttcaagataggaaatttgtcttgtcttttctgtatatgtgctataacatattgcttgccttcttgtgaatccactaagagtcacatgttggcggtatgtatgacatgttcatgtctgtctcctttgtcaggtctctcatggtccagacatgagaaggtcatctttccttattcttcttcctcatttccacccactgcagcttgtacttgggctgtttgtatcttggtaagtgcaggagcgcttcagttcatcatcactgctgctttttcctctttccacatactggatcttgcattaatgactttaaatttggaaccattcattctactgtggctgttgggctttctctgtctttatagagtctcattgcaggaatacttactaagctcctgaaaactgacacacccttgcatttgacaactggctcattattattattattattattttattgtatcatttattgattttgaacttgatgctgggtttgattaagggaaaaaacttaaagggtttttcttttttaacttgcttatcttttgaccttatatctaatttcatctcatgacaaagaagagacatgaaatgtatttgaggtggtacactgatgattccatctgaatattgctttgtcattgttttgattagaaacaataaatggtgttgacaaactctgggaatgatttttataatgaaagagaatagtgaaagtggagaagtttcaataaatgatttttaaataaaatgcttttcttgaatataaaaaacatggtgttggcagatgacattgtaggaaatattactccaagatagactggtaagccttttaccctttccacttctctgtcacttcttgtctttctagaacatctcattactttcctttatgaattcttcccccaaggctctggtgttaggggcagccttcattttccatttcagttcaagggacttaccacttaatttaagtttcctcaagtctgaccctcaactccaaagttccactcatcatttcactttttagagcagagatcacctgcatgatagtgtacctattgatggtccctgatgtttcagaggcccctacttgtatattcagatgagaatatcaacagggccttcctcacataactgtaggaaaaggtcaaaacccagaccccatagagagacctgggacacttctaatttatgaatgcaatttttaaaaagatttaaaaattaaatgctatgacacaaaatacaatacaataggagtgagtgattcacaagatagtatgagtatatataaacataaatttatgtgggtgttgtagagttgaattcaagttcaaatttggggctttttgtaaatgtgagtcacagattaatttctgacatattgtacccctcattagggatacagcattatgataaatttctaagagaaaaataactaaatcacattgtggtcatgtttttagtgggaataaaacttaacctagaagagaaagcatgtaatgcttcattcaaatatgatattgatttgctgtgtggccatggataaacaacataacttcccaggacttttttcattttttttttattggggatagtattagttaccacattgaatgtaactggatatggtgtaaggacaaattaatttgtagatatgaaatatatttgaactataaaagacttttggacttaaaatggtaatgatgatacagccccctttcctcatgaaaattaatttaaaataactagaaggaaattcaacctttattgaaaagaatctttggccaaatactggaagaaaggctccagagcccagtatgccatttcagaagtagatggtatgcccttctgagaaaacaatctcttatttgcaacaatgcactctgtggcaagtgcatgcctggaagccactgaacgtgatgaagcaactggagggtcggaggctgagtcaggagacattgagacttaccacttgtatgaaaggagtcagacagtgaagcaagcttcaagggaaactccttcggaagcagtcctgagtgacatctctctctcgcctggggagaattaaaggctaaactagatataggaatacactttaatgcatttcatggtcagcctctgacaattactgttgtgctatatcccactctgaccctcctcccatagttccaagtactcactatattcaaaggtaaattaccagcatatagtctatgaagactcaccatgtgtaaaagggaccattgcagcataaataccaaggtattaaaataattagaatagaaagcagaatagaaagcagttgaaaaatattcaccagaaaaattttgtcatggagaaaatgaaattaattcccaaatgtattactaaattaagcaatagacattaacaaaacaataacttctttgaaataatgtctcaaagcagacatttgggaaacagaaattcaggaagaaatatagcaaggaaatagaaggaaatgactgttaagcagataaaacaagaaaattagtatattagtttgttctcatgctgctataaagaactacccaagactgggtaatttataaaggaaagaggtttaattgactcacagttctgcattgcttgggaggcctcaggaaacttacaatcatggcagaagaggaaacaaccatgtccttcttcacatggcagcaggagagagaagtgcagagcgaagcagggaaaagccccttataaaaccatcagatcttgtgagaactcactcagtagcacaagcacaacatgggggaaactgcccccatgatctaaccacctcccatgaggattacaattcaagttgagattttagttgaggacacaggcaaaccatattaagtataggaaagaatagtagaaaagaatgttacatccaaagttacattggaaataacctaaaggagaatagaaacggaaaatatcaaaaagcatgtgaacagtgaaaaaatgaaacaaaataaattaacagtgagttaaaacaattgtcaggatagatgaaaataatctgttagaaaatccaaacagaaaaaagaaaagttcagcatatgcataagtggtgtgcctgaaaaggagaaacgaatatatggagaaaaaaaatgtttaaagttactttttccagatgtgaagaagttttgagaataaacatttttgacttttaatcttttgtttggaagcccaacattatgaaaaaaattatgcaaaatgatcaccgtcaatatcctaatccacttaccttttaaaacacagtcatccgttggtatcttcaagagattagttccagggctcccagaagataccagaattcactgatgctcaggttctttggggtatgtattcagaaaccaccaatatagaaggccaactagaacagggaatcttttggggagtctgaaaggagatcaaatcctaaacaaagggtgacttcagaattcctctcagtaacattccacattaggaaaagaacaggtcaatgcctttccagtgttttcaggaaaaggcagtgtaacccatgttcctagactcagtgaatgtatcttttaaagtaaggcaactgacaaacagttttcaacatgaaatactgctcagaatctagttgccagattcctttaaaaatattctgacaatgaaaatgaatagaggaattacagcaaaagaactgttgataaacattaaatatgttgaaaatattaaatatttctatctgcattgataagtaaaaatatttctgagaattatgtttacagaacagaatgaaaatgttacaaagaataataacattgaaataatttatctgatacaatttaggatgaaaagtggaagagaaggtgagaggtggtatgcatatggtgaattcttcatcttttatagctgaaggcaaaaaaatgccactcaatggtgatttattaaataacatagcataaacatgcaaaggcataaaaatgtagtaaaagtgtgtaaacaattaaaattagataatgcagtaagagaagtgattggagactaagtggaggtataaattttgtcagtattacagtgaatggtcagtagataataaagaaatgtaggattataaatattatattggccaggcacagtggctcatgcctgtaatcccaggactttgggaggccgaggagggtggatcacctaaggtcaggagttcgagaccagcctggccaatatggtgaaaccccgtctctactaaaaatacaaaaattagccaggcatggtggcaggtgcccgtaatcccatctgttcgggaggctgaggcaggagaatcacttgaacctaggaaggttcaagtgaggttgcagtgagccatgattgtgccattgcactccaggctgggtgacaagagcgagactccgtctcaaaaaaataagaaataaaaaaatatcacattgtatttaaaaggtaacaaaaaaggtaatagaaaaacatgagaccttcagattattaatagtaacacaaacaggcacaaaaagaacaaagtgaaatattgaaaaaaaaaacctagtattatcatgaggcatactgaaacacaatataactaattctgaaaatatctaccatattaataaacgcattatttatcaaattttaataagaaagttatttccacaagaaatcaataggaatggatatctgtgcatcacataacatagactcacattccataatggaaaatctacagaaatttcagggcaaaagagaagaaaacatattagttgcaggagacataattcagtgtgtgaaaactgtcagtaaaaattagtaagcaaatagaagaccactaaaacatgattgatttcaaaatgttacatatcattgtgtttttctccattaaagatatgtcttcataaattctctaaaatttttagttaaacagttttctcttaaattggattaatagtttctgaattaagaacatttaaaaaatatctttaagaaactgctttcaactttatctttcaagtttttggctactcacacttagtcttcactgactcctacatgaactgaaactctaagcataggactaagagcaagtattataaatttgaaggcccatttgcaaattactatggtaggtctctcagttttgcaaagaatcagatgttcagttggctgggaggatatagaaaggaaaaatagagtcccttctctcaaaacccccaagtccagcagggaaaacacaccttatatatcataataaatagaatatgcaagataagctccagtgtatgcagggggaaagggactttggtggaagcagctaaaaggatcttgtaaaaatataaattaacgtcttatgatgcaagaatccagcctgttttaacatggattggatgacttgcttatcagagacttggaacaaaaaatagtggatatggatcacaagttttctgtgatctttggaggaagaatatgacaaaatcctgtatgttgtccttgggataccctcctgacatccccactccctctgtgttgcttgtgcttacagtagagatggctcttctcctaacaggtgctcctcaaattccagatctcattttgctgtcttctctcaggtacctcagacttctgaccgtttttctggttactaatacagactttcattgtttttctcttttgctgcatctataaatattatgatttgtcagaaattttgttttgtatacatttatgagacaatcggccagatggggctacaagaggagacacaggagagactcgagaaaataaagtattttctactcacaggtcctagagacaggaggcatgccatacatggcaacatggggaagaccagagtggtcaggaggcagaaacaggagcaaggtaagttgtaaggcatggcctttgttggggtttctgagagaagggtaaggcaggataggatgaacagtttaggactactttgaataatttctccagaatttgggaaacaggagtgttctctagttgcctggtacctggccctgggttgcttaagacagaagaatattgtttccagggtatgtgggcaaggtagaggaaatgtggctctgggttggttagtttgcgtgcttcaggctggtccctttcctatcttaagtattggcggctgttcgcagtggctcacgcctgtaatcccagcacttcgggaggccgaggcaggcggatcacgaggtcaggagatcaagaccatcctggctaacacggtgaaactccgtctctactaaaaatacaaaaaaattagccgggcatggtggtaggcacctgtagtcccagctaatggggaggctgaagcaggagaatggtgtgtacccgggaggcggagcttgcagtgacccaagatggcgccactgcactccagcctgggcgacagagcgagactccatctcaaaaacaaaacaaaacaaaacaaaaaaagaattggctagcctcaagcaaaggtgatctcttccccagttagaaagattttctaagatatcaaaacatcacaaggtacagaaaatttaaatatacatttatctacaatacagccttgttctgggccttcttttccctcactttctttctatcatgactttcaatccagtagcctaaaatgccatctatcttctaatgacttgcctgagattcactcttgtgtatctaactgcctctttgccccatgaattttcagatatgtccaaaacatacctcttggttctcctccccactcttgcttctccctcagtcttccctttcaagataaatggcaccatcagccaaccaggaggtcaaaccagaaaccattggcttctttaattccattactcttcccttcctatcccacaagcacctacttacacccacatttaagaaccttttaaccatctactcatccacaaaacttagttcttccttcaacagaaatctcaaattcagcaacttccctacacttctgctgccactgccactatcaccctgcaccaagcaagccgctttcatcttaccccttttctgtcacagtatccccccatcatattctccacatttatactcctagctgctctacaaaccatttttgattaatattggtaaaacaaacgacaatcactccccggctcaaaaccattctcattgatttctagctgtattcaggatgaaacatgcaaaccttaccagggtccaaatgccttcctagcataacctgttcacttctctggtttttccaacataatttttttcactcttctttctcccccaactcactacgctccaataccaatggtcttttatcagtttctggaacgtgttcctggtcttgatttaaaggaaatgtaattaaataaagatctccatagaaacactgtctctgtctactctgtctaaattattcccttcctatggtattttccatttcagcagtttgtctgtttccttcaaagcagctgatcacagttgcgattacatttacttgtgaccttattttgtgttttgtcatctggacgttatgttccaggagagtagggataatatgaatggttttctcaccatcagatctccagttcaatcacagagtaataacattataggcaatcaagggtagacacatgcaggacatacccaataaataattgttgaatgaatgatttaagttcaatttgttacaatattttattcaaaatagagcaatcattattaacaaaacatgaaagagaaaaatgagagagagctacagcagggacagcatcgtaaaagttaactgggatttgggcttctattagtggcttcagctcactaagatctttataccaagtcaagtcaggagaggctggagagagagctgagaaggctggctgacaaggctgtctacactccaccttacctgccatggttgtgaccatgctatgcagcgggtctccactgataactttcttccttcagccgtgcttgccttgttactgtgtaatcgggatgtgtttgtatttcttattttggcagaaacactcaagagaaggggcttcattttagtctcaacttacaactgctctctccaataatttttgtgtgtgacatatcctaattaggctcagtgtcttcctgcattcccagcaacttgagtgacagatcattctattaaatttggggagcaatgagactagggcaggggttggccagcaatggcctgaagtccagatccagcctgccagttgtttttgtaagcaacaaattttttggaacacagctgcaccctttcatgtacgtatcattcatgactgccttcctgcaaaaatattagtactgagttgatggatattgatggtggagttcacaaagctgaaaaataacttactatctgcccctttacaggaaaagtttgccaatgtctggactagagtatgaacttctttattctgagccttagatacagtattagaatagtttaactatttttctaacatctctatttatacattattaattaatttcagggaaaattggattttgtttacatcttccaatatcatttagttcagactctattatgttccaggcatttacttaatcgataaagaaagctttttgtgacctttccatctcaagtaatctcccactgctcttaaggcctatattgttttgccaccctagcactttatctctcatagagctctatctcacctggtgctttatctcccgtagcacacagcattttgaccttgtatgtgaatcatacgtgtgcatggctaatctagcctactagtgtggcattgtgtaaagaaaattgtattttgagaatgacagattgctaggctctgagctgcatactagttgggattctgcctcttttgctgacctggaaagttgtccagcgtgtgtcacttggtagacgttttatcatgcatgaatgagtccgcattatgcctctatattaatagagacttgcctccttgatttttgtagatcacagtagaactggatctacaatgaacattatttagcatggcccatccctgccacacacacacatagacacgcacacacacacagacacagacacacacacacatacatacacacacacacccctcactctcactggtgtcttgtgtccactgtttctaatcattaaatagaggataggtttggacactgtacttttacagtcagtcgttagaatcctaactctgtcatttattgagggactttgaacaagatacaaaagatgacctttaatttcctcatcttttaaatgtagctaatcacagccaccttccagtactgtagtaggaagtaaatgagatagcaagcacaactggaaggagctggcatagctcataactcactgtaagtggtcagtagaggtcagttttgttcacaaccaaggcctgcgacttccactccaaaatgctgagggaaaccctgcttctcagttacctgaattgtagtctccaggggtgtgaaagccagggtgcttcttttaatttcctgctccccgtgatttcagatcccctcattcagtctttgccatccttgtacattgcactacaatctgccacagtgtggaagccagaactctgagtcattactgctgttccctgcatccttaaggcctcggaaatatatctttactcagtccacttctcacttagtttctcagtcatctgtttaacccaaactatgattttattttccctggtctgattgaaaaatcttcatcctggcctccctctatctccttctccatatgaaaactagaactttttttttttttttttttttttgagacagagtctcgctctgttgcccaggctggagtgcagtggtgcgatctccgcctactgcaagctccgcctcccgggttcatgccattctcttgcctcagcctcctgagtagctgggactacagacgcccaccacaacgcccagctagctttttgtatttttagtagagacggggtttcaccgtgttagccaggatggtctcgatctcctgaccttgtggtccgcccaccttggcctcccaaagtactgggattacaggtgtgagccagcgcacccggcctaaaaaaactagaactcttaaacacatatatcagacaatgtcttttcaaaaactcctaatgatttctaatgaagattaacataatatcagatccctatgcagtggtctacaggctgtcatggagatgcctctaaattaattgcatatcttggagtttgttcacagtataccaggctccaggtcccatgaactgatgtcagtagcttttaagaccaaattattttctgcctcagcacttttgaacattttatgcctcctccttgtaaatctttctgcctctgtttgcaaaggtcattctttatatccatcaggtgtcagttaaaattatactgttggagatctctatgaatactccattctttttgtcattccttttcttagaatcctgtttttcctgcttattcttacaacaatttgtaattttataggtagatagctagcaatcatttacttatttttgtttgacattcctattactttgtgtactctgtgaaggctgaactatgtctacttcattcattcattcattcattcatatatgctcagacccagtgcattttttttttgctatatagtagtgcttaatatattattcttgaatgaatcaatcatttgatcaatcaacaatgattttaggcaaatttacctctccccagcatattttcctctgagcataaatggctcactgaaattctggcctgtaaatagaaatgtatatttcctaagaagactgcgagtataccaatgatttgaaaaatgaacagaggttcttacatgactttaagaagataattccctttcaaaatgatgctttttccaaatctagtaacaggacaaagtaagatcattttgttgcttcactctttaacattttaattgtcaaagagcttggagaattctctttgaggtttagtgcacagcaaagtgtaataagaaaaagtattggtttcaggttacaattggtaaaagaaatattttaagatgtctttcagcaatcttagtgtttctctgtaatcataaatttgaaggtactgattttactatattggtagtaatcttaaagttaatactctagctgcatatctcagaatgatatacaaaacaaggatttccattttatttggaattataaaatgcttttacaaagcctgaatttgtccatagctcatgaatattccttttgtagtgttgttttgctattttagaattcagcaaaagaaacttgaattcagactacattctaagcatcaataagtatagcaatcctataacacaggcaaatataaatgcctgttctaaaaaagcttaaaaagaaaaaaaaaagtccttactgagtatataaaatattacgtttttactcatttaatcatcatccatgaggtgacaactattatctcaattttgccagtggggaaagagtcatacagaaaagtcccttgttcaaagtcacattggtagtaagtgactgtaaggatttgattgcaagtttcttaaacatcaaagttcaggttcttttcattgctgattgccttctgactttttgcatcatccagttctttttctttctctccccctacccttttccccattctccattccctttcccctaccaccttgagacaaccattctaatttacataatgtgtacatctggatttgtgtgtgttcttacatgcattttttatttacttgatgctagtttccacttttttgattaaacattctatttttcagctcacgttgttgtgtgagcatataatctatcacttctcattgctgcatgattctgtccattaatggaaaacctgttttcttctaaccttctaccatcataaattactctgcagctaaaaggcctatgtcacttatttttagtgcattatttttaggttataccgtatatatatatatataatatttatataatatatacttcttgtgcctaaagttctttacttcctccaagtcataaagatattttctcatggttttttcttatatctataggtttacatcttagatttagatttttattccacctttgtatctgctgttagcttagttccagttttattttgatatatagtatgagccagtatttataatacgatctattaaacaattaaatagtttaaatatttttgtattgtattcacaaaaaggaacttatttttaacttctatgtgtgtatatatatgcatatatacatgtatacacatatatacacatacatatatattttttgagatgggagtcttgccctgttacccaggcgggaccataggcatgtgtcaccatgcctggaaaatttttgtatttttagtagagatggggttccgccatgttggccaggctggtctcgaattcctgacctcagatgatccggccgccttggtctcccaaagtgctgggattacaggcatgagccaccgcacctggccaggttgcaccatagtatctaaagatttttctgtgtctttacaaccattttttttgccaatttaattggtgtaaatgatatttattgttgttttaatttatctgattactaattaagcatctctttgtttacctattagcattattagtttggcagtcttaaatatcacaaatatccttcttcattctgtaatctatgactttttttgcttattttttgctgcctttgctttaaaagttcttcacttcctccaagtcataaagatattttctcatggttttttcttatatctataggtttacatcttaagatttagatttttattccacctttgtatctgctgttagcttagttccagttttattttgataatatagtgtgagccagtatttataatatgatctattaaacaatgaaatagtttaaatatttttgtattgtattcacaaaaagaaacttatttttaacttctagagaaagaaaagtgactcttaatattataacgcctttcccataatagagtgtactggtattttttttaaaataagtgcaagtcatattttatgcctgttttgaatctgatcaaaaaaagtttttcctatttgtgtgagtctgtaaaggcacatttccttttgttttttctgctttagcctagagttctcgttggaactgacatgacataggattttacattgaatagttaaagaaaaaataactctttttccccccagcaattaatataccactatcgatataatgtgattttatcagtttaaatggaaaactgaaattaaagagaaattctctattaaagataatttattaaaattggtaaattatatgcatttgaataaaaaaaatcattaacagacttttatttcttttccaaatatgaagatgaaagtgtagatttcagatacatataaaatgcatgttttattatagcattatatgattttaatagaattattttccactaaatgatggttgcttaagaattttggaagaatggaatttttgaagtatgagctagaactgaagggaagatgaagagtccgaaatggttcctaattccattaggggaaaaagacttttcaatcagtcactcgagtgtccacagagaaacgtctgatgctatttcaggggataatctagtggaggaagatggcctcaattgaaatgcttagttgattatgtagttcattccagaataaataggctatttactttgtctgaaagttcaatagatttggatttcagtcaaatggaatggcattagatctttctttatgaatgttgatacaagtgtgtttagagaggacttctgtcagtttttattagtaatattcttattggttgagttttcttctccctcatttgctcagtgctccaattttgtggaggtcattttatttttgacgttatgacataggcaagtagaagcctctaagattttttttaaaaaaccctgttacaatgttttattcttataattttgtaactttcttaatcaaatgctgtggagacaaactgcaagaggaaaggttctttttaagggtacacacatgttggagatgaaattccttgagtttttgggagaaaataagaaacctgctgattctctgagctagaataatttatacttttctatgaacattagagaagtgatatactttaaggtgtgaggacaaaaacttgcaaaaaaacaacattgcatttgaattatagatggcatctaaatgataaaatgtataaaaatatccctaaaagataatttctttgtcataattgagaggggagcagtagcgtataggagagtttgccacacagaagatcaaatttcagctctgacatttcctactttgagaatctagctgaattacaattctaaacttttgtccttatcagtaaaatgtctatatctgacagtatacaaggggtatcttttgtgcctagcttaactgggccctcagctgtttatttttttaatttttccttctgtcctccatcaccattcccagattcttacattaaggacaactaagctaaacattactcataaggaagacaccttgtttgttttattaatagctagtttagcacataatacattttaaattgtctgcctatgactaatggcaaaaggtgtaagtccgtatttctttagagaagtaaaataattggcctttatttacagtgatcttgtaatctttgttcttttgtggtggttactaattatgtcagtgtcaaactaatcatattaagtaatggaggttaaattcccccagtgatttagaatacaagaatggaatattttggcattaaagaatgacttttcttttggaagtacatcgcgaagtctttgcaatatacatatttgtcaattaccatctgtgtaaagcaacagacagctgctcagtagcatttcctggagtggactggaaggatctttctcaccatatgactctgagacagttagagacccaccaaattgaagattacttgatgtaaattcacagcacatacctggttgatacagtttatattaacatgtttcttctaagaaacaataagctcttttttttcaataaggaaaatatttttatctgggaaaaactgtacaacatttatatagtgaatgatattcttttaaaataatttgttataagcctttcctaacagtgggatatgacaaactagaacatgtgcaatacaagtgatattttaagaagacactcagaaatgtaatccaacttcaatcgtggatgccccccagttttgtttgttttctatgtctggaattttcttgtcataaaattctaaattatttaaggtgaatatcctttgcaaaagatggtgtctaaattatgtctccagaaaagttagaaacctgcagtttcaggaatattttcattgagtacccatcaagtgccagaaaatatattagggacaaagaacatttctgtaaatagaacaggcaatgatatttgcccatctgttgggcttgtattttctctttgagtaaccactatgtgctaagtgaaatgtagtcaatttaaaatggtttataaaataataagaaaaaagtcatttataggtacaacattctttctaaggagtgcagaagctgaagttattgttttgctgagacctggagaggtttgcatattcaaaattgggggaagagctaattacttgtattgtagaagaagactttggaattcttgtggaggagattaggtggagagagagggtgggggtgtgagagagagtaagaaagaaaaagtgaagtacatgtgtttcccaaatgttgtgtttctgtacatctcaggcagggaacccattctccacccatctgaccacttctgccttatttacaaattttgatttgctggaaagggaattctactggcaaatgcacagtctgtttctcactgatacaccttggctgagtttctacctacagtctgacccttttgaacagaaagtgttaaggacttcccgttagggctcgtgcttaagcctcaggttgaacctacttgatccttaagaaaagcaaacaaagcaaaactctcaaacagaaagcactgtgtacttatttccttccataaaattttattgtgcactgtgttgcagggactttgctgagcttcacaaatttccttcatacaacttttactgcatgtaaaagagacccactccaaagttaaagtgatatgttgtcagaacatgaaatcaaaccagaagtaaaaatactggatatgtaaaaaatataacagccttctagtaaatatgcaaaaatcaaaatatgcaaaaaatcagtcttctagtaaatgcaaacatattggaaacatgatcattactgataactagaaatatttctaatagcagaaaataaacagaaaatggagaagacataatcaaagaaataataaaagaaaatatgacttaaatttacaatacaagtgccccaccacaatttaaaattttaaaaagacaagctgaaggcacatatttatgaaaattcataatactagagttaaagaaaaaaatttaaggtctttagaaataaaaattaagtcaaatcccggtgattagtactcaaaatgactttacactttccaacagtgatcctagaaattagaagaaattgcagcaatgtattcatattctgaaggaaaataactatctttcggtctgaattgtcatgattatataaaggttaagtaaataagttactccaactttcccaagttaattttttaaagaaacatagatcttgacttccagctaatacacaaagtttttaacctggaggaaactgctaactgagctgtgatggtaagtaaaatgtgtatttcttttcttttgggtacaatagctatatcattatacagcaaaggagagaaattgctacgcaggatttagtgatattttcaaggatagcatttaataggagaaatttctgcttgaggtgaagatctgtctggaaatttttgttagactaatttttttaaatgttaattatgatgctatactttttctgaatcagttcaaggagattaatagtcaaaaaagaaggtgtgcagacagttgcttaatgagatctgagaaggaaatttagaatcctatgttcttttcatcatcaacaggcattttacctaaaagtctagaaagacaccattgtgattttttttcctttgtcctgtaactctttcctatggcttggacagtgacaatagcattcgtgctgttcaactggcagggaacctaattatggctgttttatctgaagctcagataatttcagagctctttgaaaagattattaccttaatctaccagttaaattcttcagtgcacttatgagaaccatagcatcaactctgtagattgtaagagaaatctagaatttagaaagatgagggagtgagcaaaatgagcattgaattagatgtctggagacctaggttctggaactatttttgggtagttgacctcatctttttggagtgccattgcctaatcagaaaaataaggacgatggaataggtggtcttctgaatctaaattattttgttgaatttttttctctactttgaattctcaaaaatattttgctttagaagcgttctattagtatgtataatgatgtaaagcagcggtccacaaccattttggcaccagggatcatttttgtgggtaacaattttttcacaggccagggggtactgagagcgggggatggtttcgggataactcaagtgcattacaattattgattgactgattgattggagacagagtcttgctctgtcacccaggctggtgtgcagtggcttgatctcggctcactgcaactgccgcctcctgggttcaagcaattctcctgcttcagccacctgagtagctgggactacagatgcccaccaccatgcccggctaattttttgtatttttgtagagacggggtttcaccttgttgcccaggctggtctcaaactcctgagctcaatctgccctcctcagcctcccaaagtgccaggattacaggtgtgagccaccgcacccagccagtgcattacatttattgtgcactttatttatattatcattacattgtaacatacaatgaaataattatacaactcaacataatgtagaatcagtgggagccctgagcttgtgttcctgcaactagagggttccatctgtgggggatgggaggcagtgacagattatgaggcattagattcccatagggagagcataacctagatccctcgcatgtgtagttcacaatagggttctcactcctgtgagaatctcatgctgtggctcatctgacaggagacggagctcaggtggtaatgcaagcaatgggcagtggctgtaaatacagatgaagctttgctcactcaccagcagctcacctcctgctgtgcagcctgattcctaacaggccaaagaccaatacaggtccatggcccaagggttagggacccctgatgtaaaagacttatatatgttggtgaaaagagcagacacagaggaaattccacacacacatggatttaaatcttggatttattcttaggggcagtatcatctggaatggattattctgcctctctgagattcaccttctacaactataaaaagagaaacatggcacttagttttcaatatttttcaaaaattgctaatagtataagtacctgacataataaaaacattcaattaatagcaactgttatttgtgtgatgttttctaacttaagaactaggacatgaatttaaccacacaggaattctcatttttgagaagataaagaatgaggaaaatctgaaaaatattggaaatcattaataaaattctcctttgatcaaagatttatttcggcattccctaatttgccctgctcttgggtacgttagaatacatttatcctactttacactttgaaaaatttgtgcaaatgccatgattgtagcattagcctgattttttcccagtcttctggtttttttttttttttttttttttaactcaacatatattgtgaaacactcgggtatttattcctcaggaaagtatgacatatgaatgagagctagaggataagatcttgtgataataaatttttgaggttagtctctctgtgtccttgcagttttcgcatgtaactacttactctgtggagtctacacttatatgtaaaaggcagtttctgtgttagctggtttattttaaaaagaaaagacttggggcagtgaccatctcccttatctgaagacagtgatattagatcattcccagactggcctattttgctttcacatactgcaaaatgcttgatatgcctcatttttgtgctttagtaatcattcagactttgacatgcatttcttgagggtgttataacatgtttttgaattttctccaggaagcactctgatgatgtgatgaataatttagctggataactatttactagagaaaacacgaaggatgaaaaaatctaaacaaacttttttcactgagataaataatgagggcacctactcttttggcaaacggtataattactgctttcctggttaccagtgaaatctgggatatgctaatgctttggcataaacaactgaatataaatctcaataattgaagtttgaccaaaagaggggttaaatatgtctaagaggtcaaacacagagcagaaaaaaaagaatgggaaatgatcttagtctgaatcgcaagattgcatgttttgcttttactcaaaagagaaggaactggtatttagaaggagtttttttttcagagagtaaggcgttcagagtcactgggtctgagtgtgaatgctggcccacctgctatgtgaatggccttgagcaaggaaatacatctctcagcctggttttccacttctctaatataggatcacaccctctgccttggctacataagagaactgttataaggtatgctaaagttgcaactgagaaaacctgccgtaagctataaaggactaggaaatgtcagaaatgattgtaatgctgttggcccttcagctgcagtgccagctgcagaaattaaaaggaggctgaaaatttgatgttgcccttggaagtgaggggaaacattgttctcctcagcaaacctggtctaacatgtctgccaatccagtgaacgtatttcagcatgtgtcatgtgggatgcaccttatgaagggctgtctatacagatgttagggtatatcttagttaatttggcttataacaaagtgccatagagtgggtagctcataacaaataaatttatttttcacagttctggaagctgggaaatttgagaccaaggacccagcatgttcaggttcctgtgtgggctctcttctgggctgcagacggccaccttctcgcatgtcccctcttagaaagagaataagagagctcttgggggttccttttataaaggctctaattctgtttatatgaactattactgatgacgtaattacctcccagaagccccaccttcttatgccatccttttgggggttggaatttcaacatatgggtttggagagacacaaaccttcagtccattacagggtccaagttgcttcatgatccacaaactaccaaaatctaatacttgatacaaattcacccagaaaaacattagaatacagggatctgtcttgttctaaaatgggaatttattatgcttaaaccaaaccttatagtgaatccttgaaaattcagaccagagtctgaatgtacccctctagggtacttaccacttggatatttctagtaatttataatgagcattgagactgcccattcagatatattcatatacttctttaaataatcaaaacgtgttttctcttcccttctatttactgctgattttcattctacctaacttctctgcaaagatggtttaccttggtaactagcaataacaataataataatagtaatagtagtaatagcaaaggtatcatttacttaactccatcagaattttacatactcttatttctgattttattatttctttaccatgcaaatttgaacagaatcatctctgtccaatggcccatctttcttattactcatccactcttaactgcttgcaatgtataaccgtaaccctgctctaaaactactgacctaacaggcagcagggaattccttttattcagttcactagctctttcaaaattctaatctgctttgacttttcagtaccatttaactctctggaataatttctttgtttttgaaatcctctatactgtggcatgtcaatttatacctttgtgagagcttcttggtctcctctgtctactccctctgttcccagtccctgtgtgtaaattctgccctctccattcccactgtgactcctcagttttaggctgtcatcatttctcaccaagatgttgaactggctcctccgtgagagagcagagtggagaggtgaagcaagtgtctgcctgccttcctggtccatgacctctccctgcccttccatgctgggtgaccatctgcatgtaaagttggttttagctttcttattggtgaagtggggataataatagtatctattttttggatgaatgggaggggtcaatatgttactacgtgcaaaaatgcttaaaataattcctggcccttggtaagtgcaacataagtgctgccattactgtctttgttttaatattagttatgatcattatcattttaagtggtctccctgctgttggatcacttgcttccagtacattctgtacacagcagtcaaattattgtaaaacaaagcttagtttatgttactaagctgtttcatattcatatttgcattctatattgcctaacaattttaatcaggccctcaatagtcctggtttgtgtttcctggcttgtctgcaagtctcagtataatagtcagtactgatgtctcccttccccaccgtgctttccttactttctagaattgtgctttccttccacctccattaaaatcctacctgccattcacaagacccagaacaaatgctaccagacccttgatgccttttgtaatcctctatgatcaagcataagtctgtcctctctgaaactattaagtaaaggtctttattttaggtttctttttggccccatatctctgtatttggtattttatttatttatgtacatgttgttatcttttttcctagattataaactccttggggaagagcctttatatggccttccagctccctgcacaggacattacatccagtagacagatgttcaatgaagggctattgaattcatgtggatttccatgtgagaatagagctggatattcacttccctttttgctgtgcttgctaagcagactcatttgcaccggccactaccccagttggtcaccaggaatagagggtacttatggagattcttttcccaccccccaccatcttttaggatttagatgttgtttatacactgaaaagttcagcttttggctcatagtagcagatactgttggatatttgttgaatgaaaaagaaaataaatagtaaacatttgctgagtgagaaagaaaaaataaataatgaataaccacaccctgacccacttgtctgccagaagtgggaaaaagttgtaaataagcattttctggaggaaaaacacacaacccacacttgcttctgaatggtgtgggaaacatagattgagtctaaaattgagaggcatgcttatgtttactaagcacatggagaagcattatcagaacactactggcttttgcaatacattctttcgtcttttcaaaagtaactttttctatcacatttggcttaggttaagattcaaatcaatttacccttcacttgattcgtttttgtcagtgtggtaaccttatcagcaatgcagtttgcacccaaaaagatttgctgcagaaatgaatgaggccctctaagcccaatgtgaatataaactccacagcgatggtagaaatggtctcaggtgacccgtcagaataagaagtacttcctctccagaggtcctggcttgttatcccccagagccacacagtgaatgaagctaaactcctgttcttgaggtggaattatctcataacatttgacactttagtagtttataaagataacccaggaaataaaatttcaggagttgaaacaagtattcactgaagacaggacaactaaaatatgccacaaaaattgaggatcaatatatcaatatggaaggtttttaaaaatttttatttgtttaacttttatttttgtgcttggcttttcttgggatgtatttaggtatgaagacagtagaaataagatgtatacactttgggaggctgaggcaggtggatcgcctgaggtcaggagttggagaccagcctggccaacatagtgaaaccccatctctactaaaaatacaaaaaattatctgggcatggtggcaggcacctgtaattccagctacttgggaggctgaggcaggagaatcacttgaacacctgggaggcggagattgcaattagccaagatggagccattgcactccagcttgggcaacaagagcgaaactccgtctcaaaaaacagaatgacttctgctgagatatcaagaccacgttggtcttgacccctgcttccaggaagccttgcttgactgtctagggctgaattttataccattttaaaagaccctgctaattcctgtccttacatacatcacatagcagtgatcatttaattgtccagactccccatctacgtcacaagccacctgaaggcagatcacaactacatagctccttgcctggtgcctggctctagtctatatttaccggatgctgtattaaaagaggtaaaaccaaggcatgagtctgctgttgcagctcagaggcctcaatcagacagatgccaagctgcatttgatcggcagtcttgtatatttgactgacaacgttctggcttgcaagtatttaataacaacagaaagtgaattagtcaccaatacataaaaattgagagactttacacaaatctgaattcctgggctctcttgaaatacctgaaaatctgacgacgttggacgtacattgctacaaaaacctggagaagaatgtcatggctatgaatagtgaaagtattctccactctatcctattccccctggcacttaaagcttccttagttctcacctctaacaacccactgggcctataggaacttggagctgttccttctcttcctgggtgtctcattagagggatgaccccaagcttctcctccccctcttccctctgactcttcctcttgttaaaagagcatggatcttgcttcctaagaaggatcttatcctctaaagccattgtcctgctgagcgacaggaagctcctcatctacagtggccctgcaggtaccgagaaggcttttcatgcagctctgactccacatgggagtgatcacaatcaggattccctcacagactgcctggcttcagtgctgcactctcctgccttgagtcttgaactgcttcgtgatcctgaccacagtcttgtcacctgcttggcctgagaagcatgaaggtggtagatcctggtgccgctcctgaccacccagcagataacactttgattttttttctaagtagaaattgatcagtgtgggatttcgagattttcaaaggtgcctttgtttaaatcgagaattgggcaaggtagggatcttcgttaaaaagcaccatgtggtcaccggggttaatgaggcagatcagagcagcactgacactaaataaaggccaattaactccaatcactgcaggcctgggtgctttctggcagtgcaatctccctgtggggggcttcttgtcctgacaactctctggcagaggtaaggaggactggctccaaaagaaggcccctgagcaatggtgtggggtgagggcattgcccctccccaccacactgcccatcaggggcttatggcttttcttggaaggcatcgcccccacccagcctgccctgcatggtgctgtggacagagaagcaagactcagagactgaggccttctgtgggctcccaaccagctcaggggccaagcacagagattcagattctcaagaccccttttctctatccatttaattaattgccttgaagagaggatcacagagttcttgctgaaaaattatttaagtccatgaatgaagacaaatgatttcaacacaaacattgctcaattgggtacaaaaaatttttttcccttgtgtttgctttagtgataaaaatagccagtgctgatgatataaatttcacctcgtgccaagtgctgatctgaaacctttacctacattggctcagctggtcttcacaaattttctatgatatggatactattattaatcccatttatacatgggaaaacagaggcattggaaaagttcagttctatgctaggtactttccatgcctacttctatgtgattctcataaaaacctctgtgtggtgagtatttttagcactatattacaaatgaggacactgagattcagaaaacttgtgtgacatatctggtacagtattgctcctaatgatactaataaaatgaggatttggattcactttttttttctatttccaaagtatggtggtatagaatagctaactgcctaggctgaaggatttaaaatttttccttaagatttatctgtgagccctcagtttttctattcaaggtttctggattggagagtataatcagtaccaaaaactaataatgatcttaaaatagtgggtacagaataatgcctctggctccagcttgctccattgagtttcacacctggctgtattactttcttgcttctgacttctttcagccactaagccgtggatgttctcagtcctcagtcattaaagactagaacatcgcccaaagccaccttcgctactgcaactacagtcattagcataacagacctcagcatccacagaatcacttcatccaacaccccgatctctcattccctttgcctcctcatctccaaccaccttcttcgcttcgtctaagccacacatttcatcatcataccttggaatttcccaataccaacaactatatcagctctaatattccatgttaaaatgctccatttgtttatcaaacaccctctgttactatctggttagttcaaatacctcccatattctctgacctcacgaaactcccaatttcccccaacacttagctccctgggagcaccacttttctttcactcctgcttggatgccatgattccagcattagttgctctcttcctacttcaaacccacaagatgaaccttcctatcaaccttctccacattgacaaccaagaagttgtagacaatcacacaatgggggagcttggctgtattgtttatgacatacattcaggtcatctctaactgagctgtcagtcctgctcaacagtctcactaatttttctttcgagctcactctcccaccttttatgctaccttataaatagctcttctccaatccttccgtttcttttcattctcacttcaaacacaccagactcagccaccatcaccttactcaaaagcacaaatatttttctaatcagtcttcaattcagtcttgccactttgcctattcattcaccacacataagtcaaaataatgtgtttagatcctacattttatcatttgattcccctgctttaaaactttagtgtcattccatagctaataagataaaataaaaattcttacctcggttatcctacaagtattggttcatctggctgtgcctaaacctcaccattcttgcatacaataatccacccctttacattctaccttcatgatcttattttagtttcttgaacatgccaagcttctttccaattcaatgtattttgcatttgttacttatatacttgtctgtctctgaaaaacagctcccgttcattacccagctttcactatttcaagatctcaacttaaatatcacattcacagtttttcacgaagccccctctacccctgtctgttgtgagtcactgctcctgtcattcactcttccagtgctgggtgcttttcctttaaaggaccaaccatttttagaatatttacatatgtacttatatttttaaattctatcttggaaatcagattgtaagattaagaatggaaggttccagatatgctcacttactattataagccaggatctagtacagtgaaacttgagaaacatcttataaacatttaattcactttaacgtaaactagatttgataccttggacttggtgttaacctcccagaacctaatttcctgagtggcacaacaggggcacaatactcctgagaactatgatcaggttgcagtgtaataatgggtggaatccacactttggcaattctacagtgctttgccaactacaaagctgatgacctcagtgacagtgagcacacccagtgcccagagcttggtttgtaataccattcatcaattaaaacaacttggtttccttggagagatggatgattctagggttaaagcaagaaatatatatttacctatatgaacctggagcatcttatactgccagaaagcaaggaagtgctaaaaacaaaacaaatacacacacacacacacacacaaaacaaaaacaaaaaactcacactgattgttagatatcaaagggacacaggagccaacaaaagtatttcaaatggccaaagctgaaaaaatttgagcaacaaaataaataaagtagttttgtattataactgaaagtataagacaaatgttgatgagaccatgcagatataaataaataattgaataaatacaaaaatgagaaaaagagaccaatatgccatgcagaagaatttacgataatttatgtagatattcagtccttgaggtgttggctgtacatagtgaccttgtttctccttcctgaagagtacacagggaaagaaggaacaaggaataactaaatggtaggaaaatctgacaaacactaccccagcccggtaatcaaggtcaatactcacaatcataagtgatgctgatattatgtacctttgataggacatgatgaaaatggcactttacatctgtagtcttccttcctggaacccataaacccaatctaattgtgagaaaaacaccagacaaattcgaatcatgggccatcctataaaatacctgaaccagaactctttaaaaccatcaaggtcatcacagacaagcaaaatctgagaaattgacacagccaaggggaggctaaggaaacatgacaatggaataaaatgtggtctgctggaggggatcctggaacagaaaaggacatggggtaaaaatgaaggaagtctgaatagactgtggactttagttgataacttcctatcaatattctttcattcacagtgggaaatacaccatattaacgtaggaggtaatgcaattttatcttactttatggtggaaataatagaggaaactgggtgtggagtatgaggaaaacttctgtactgttttctcaatttttctgtaaatcttttttttttaaaaaacaaaaaacaaacaaacaaacaaaaaacacagagtcttgctctgtcgtccaggctggagtgcagtgtcatgatctcagctcactgcaacctctgcctcctgggttcaagcaattctcctgcctcagcctcccaagtagctgggattacaggcatgcatcaaccacacctggctaatttttgtatttttagtagagatggggttttaccatgtcatccagggtggtctcaaactcctgacctcaggtgatctgcctgcctcagcctcccaaactgctgggatcacatgcgtgagccaccacacctggtcaatttttcaataaatctgaaacttttcctttttttcttgagatggagtctcgctctgtcacccaggctggagttcagtggtgcaatctcgtctcactgcaacctccatctcctgggttcaagtgattcttctgcctcagcctcccaagtagctgggactataggcacacgccactgtgcctggctaatttttgtatttctagtagagatggggtttcaccatattggccaggctggtctcgaactcctgacctcgtgatccacctgcctcggcctcctaaagtgctgggattacaggcgtgagccactgtgcctggcttaaatctgaaacttttctaaacatgaaatctactttaaaaatactgtgcatcatcatcatcatccacttgctgtggtctaaaaatactcagatgtatctaccttctttcccccaaatcgatgcctttgttgttgctttcaatgtacgttattttgaatgctttgtatactgtagagtgctccacaaagtcaggaagctctttttcttgtatggctcactgccctcttcaggtgtcacgctggatgttctcaagttatctctggtcttgtcaggctttactcctccttcctgtcctgaggcacaggcttgcactccctctttctctacctctgtgtttgctcacactcttgctctctatcctgctgctctaccttctctttctgttcttgtgggataactatgggaataaaattcagatttattttcctaattctcttctgaaaattttgaactggggaatattgatgtcttctatttctatcttctaactttacaaaataaggatattctccagattcacaaggaatgtgtatgagcactaagagaatgcatttggaaccctttaggcaatggaagaggaaggaccagaaattcagcaaaatcaatagctgagttcttacagagaaagagaggcagggaacattatgtctctatctatgatgagaggcatgtttttctactctctaggaaatgacttcctgcaaatgatggccagataaatcagaggtcatggtccgtggaattgctatttttctcagttgacaatgtgtagacgacagggtttataaccagtactacttctcatgccatttgctctgattttataacagcgacttcagctccaattgtggacctgattgcaagatagtcttaaattctcaaaaggagctagaaccctggaatgtatgtaaattttttaaatttatttttaaaacctgaatgccaaaaagtatttgaatgaaagagtcaatcagtccaaaaacaattgcgtacctctctggaaggtctagtgaaagggaaagagaagagagaaggaagaaaggagaatggggaaaaaaaacttttcttccttttacatatccagctgtaatgagttcagaatgcaatattgtgccagtgggttacagtgtgtttcataaaaggccttcaattcatgttagttgagtgaataaataaagagatacattgaaaacaattttaaggtcttttgtaggagtgattagcaaacatttataaatacaaaaaaaaaagttattaagaattctaggccgagcgtggtggctcatgcctgtaatcccagcactttgggaggctgaggcaggtgaatcacctgaggtcaggagttccagaccagcctggccaacatggtgaaaccccatctgtagagatatacgaaaattagccatgtggtggtgggcgcctgtaatcccagctactcaggagcatgaggtggtaggattgcttgaacctgggagacgaaggttgcagtgagccaagatcacaccattgccctttagcctatgtgacagagcaagattttgtctcaaaaaaagaaaaaaaaattctgatttttcctatgatgtctatctaacaaaataaaatcaccatattttcttgcactttgccctgaaaagcatagtattaatatggaatgaattggagttaggtaaatctaagtttaaattctacccctattacctgctaactacagggccttacatgagtggataactctctcctccttggtgtctgcatcttgcataagtctctggctaaactcatcaattaccagatactccccatttatttcccagatagtgcctaacacacatcctttaacagagagcaaggttttgtagtcatctctctttgtaaccgctttgttatttaatagttgtccagatgcagcagtgctgtaggtgctgtacgagaataaaatgcatcagttaaaaattattccaacctagtttattgacattctcaattatattggtcatgaatggaacgttcctagggaatagatggtgataatagttgtgctcaattatggccttatcatttttaggtgtcctctgttttctatgactcataattaggactcaacatttttatatttgatcattttatttttcttattagagtccattattctcctgtgaagttttgccagagatatggcatacaaattggatttgtgtatgctgtatactaagtagacatttgaggaatgaaaaatatgaattcacaaattaggcaggcatccttgttgtatctatcatatggattttcatgacacagactaaataacaatcattgcacaaaggccgtagtgcagcagggcaaatggtggagttacttgtttgatattaattcagtgctttgcccaataatgcaaaattgtcctaatgttacatttgaggaaaaagacacatcgagtgccagcattcaaacaggcagtgtgttaaggatatgtttataggttgccttatcaaacagttacaacaaaccaagagaggagttgtctgtccttcaaagtttagatgaggaatgtgaaggttggaggtgtgaaatgccagtcttatggccacatagctcccttgtgatagatccaggatttaatgctgggtatatttcacatcaaccataacataggtcttccactttgagaaagatacgtatttaattttacttggaactcgggaaattagaaacaaaagcagctgtggattgaaagataggaattgtgcagattgggcctgaaactgatatccccaggaaactaattgtgaaatggaagatgaaagttgggtgctgggtgtgacagtctctgggattattccagagctcagacctattctgtggccttatggaattaatgcaaccccatatgaaagggagcttttcagtcaccatgggttaatttcagacaaataaaacatctgccattgatcgaaaatctgaatgttcaattttacagaagttgttatctttttcacttcagttcactttccatttaaaactgaaaatcaatccttctcagggcctttgtgtgtttttggagatgcacactacaatttcctgccaaaatacttgtcaaatgttagcatacatttgacaagtagtccttgggccagagtcattaagataaaaaatcctggtttactcaatctaggaagacccagcgcacctgacaccaagtctgtgcagagtaaccttgaattcaggatgtttatgaaaattccagcacctacactcctctttattaattataaattagatggcacaccgtagtaatcatcttgttaaacacagccataggcaaacttagaaaaagaaatattaagtaaaaagtagtataataaaatggcagcagaacaactaggatggagtttgcaaacactgaccactccgtaacaatgaattaggctgggtgtggtggctcatgcctgtaatcccagagctttgaaaggcagaggtggaaggattgcatcagccccggagtttgagaccagcctgagctacatagtgagaccttatgtctacaagaattgtttaaaaatattatccaggcatggtgctgcacacctatagtcccaactactcaggaggctgagcggggaggatcacttgaggacaggagtttgaagttaccatgagatataattacacctttgcactccaacctgggtgacagggcaagaccttgtctctattaaaaaaacaaaacaaaactgataaacaaataaataaatagataaaaataaataaatgttattcaggctgcagccaagtatttcctgttgctacaatgccatactttctattccctgtcccacaaaatacgcattcatttctaaggctgaaaagttgcctagacagggttggttcataaatggattgctctttcagtcataacaaaaagcgatacatcttcatagtcaggctaaagggcttagtaattcaccttatctgtgtatctcctaaagaaattagcaaaatcactgagtttggcgtttgtacttggtgccctggctttggtggaacctataatagtggtacaaataacacatgggagacgtttataatgccaaagcagctagagttgtaagtgcagcattataggagtagagtcatgtctttcttggagcatcaggaagggattcttagaagtgacatgtgccctggattaagtagaggcctgaggcatcatattccttcaactttccaggaaatctcaattatatctggaattagatgctgggaaataacatgacaatgacaggttgggtaaagacaatgaatgggtcaccaagaggtttgccatttatcttttaagccatggcatttgcagtgggaatatgtcaggatcagatttctggtttgagatcgctagagaagcagagtgagaatggactggagtggtagtgactggtgacagagagaccattttagtcttctccatttcactgagtaaaattagggagatagtaaatctattaaaaaggtagtctaagctgagctggggaaacatgacccccccatacaggcaggacacaataaatgactaataaaacagtatacatttaggtgctacatgatgttgtacagccttcatgtggtaaaggagttctgtgaagcaagtgagcagagaggtctggagttgataggcttggaaatttgtttcctcaaaatctcatgttgaaatgtaatcaccaatgctgtgagtggggcctggtgggaggtatttggatcatggggcaggttgctcatgaatggcttaataccatccccttggtgatgagtgagttctctctcttgcagttcacatgagatctagttgtttaaaagagctagagactgatatggtttggctgtgtccccacccaaaatctcaccttgaaatgcaaaccccataatcctcataatccccacatgtcaagggagaaaccagctggaggtaattgaatcatgggggtggtttcctccatgctgttctcctgaattagttctcatgagatctgatggttttataaggggcgccacccgcttcactcattcactctcctgtctcctgccaccatatgaagaaggtcagtgcctgcttccccttctgccatgattgtaagtttcctgaggcctccccagccatgtggaactgagagtcaattaaacctctttcctttataaattacccagtgttgggtatttctttatagcagtgtgaaaatggactaattgccgagaccagctgggtcgtggagaccttaacccagcggcgctagaggaattaaagacacacacacagaaatatagagtgtggagtgggatcaggggactgacagccttcagagctgagagccccaaagagagatttacccacatatttattgacagcaagccagtgataagcattgattctatagattatagattaactaaaagtattccttatgggaaacagggatgggctgaaacaaagggatgggctctggctagttatctgcagcgggaacatgtccttaaggcacagatcactcatgctatttttttgtggtttaggaacgcctttaagcagttttccgccctgggtgggccaggtgttccttgccctcattccagtaaatccacaaccttcagcgtgggcatcatggccatcacgaacatgtcacggtgctgctgagattttgtttatgaccagttttggggccagattgggggcctgtgcctgacactaaacagagacctcccccttctttctcttactcctgctctcaccatgtgatgcacctgctccccctttgccttccaccataattggaagcttcctgaggccttcaccaggagcaaatgctggagccatgattggaaagcctgcagaaccatgagcgaactaaacctcttttatttattacttacccagccttaggtatttcttcatagctatgcaagaatggactaatacagtagtcatcaaagtaaaggtgagatttgagttgactattgaaaggggaggaaggaataacataaattgtgtcacagacaaggattggttggtaggacacggagtagtgacaatcctgacatgcccatgttttatgcttcgatttgggaccttaaagtattcagccctactctagcaaaaatggccgcatacaggaaaaagagatcattctgtttgacattttgtatctagagagatttagctctgttgcttgttttactgacttgtaagtacactcattttgttctcacagtattttcttagcttttacattctggctactcctatttccacctgaacaaatgagaaatttagttgctaccaatgtctagccttagtactgctctgttctcagggttcagtgtttccttcaaacaatgtgttaggtaataatcaggtctgatacatgcagcatctgtgaactccttacttgatgctgtttgtttttaataaatatggtgtcacaggtcataggtggggatattttaataagtgacactaggatggagtacttactgactgctaggcgcagtgtgccttctatatgtgatctgctttttcccttttacgaacacgatgaggagggtgtttgaattgccatttttgtatatgtaaatagaggctcagagagttaaaaagcttgtccaaagtattcacctaggactgtgctgattaagaatcttagcactaacctaatttttatctggaatgctggatacaattgaaagtttatagttgaggataggaaggaccaaagattggagtcttatcccagatcattaacaccagttaggtcatgcatccttccttacctgctttgtataaaaaataaaataaaatttaaaagtgacactagaacaacgtttgtcttgttaatgtctgtaagatggtttccaaaacgatgagtctggggacttaataaagcaatttagaagcttttgcagtagcagtaacaggaggtgggtgtacatcagtgggaaagaaagatgtggatggctgagggaagaaaataaagaaaaacggatacaagatagagatgattgaattaggcttgaattactcaagggatgggcaagagaaggtagacaaggctgagatttttgcctctaaatccacaaagttcatgcactctgaatgagatttggagcattttaaaaccttttaagttttctattgaacatttttatcctccaaatcattttcttccagtgtgctaagattatagcctttagctaatggttttctctctcagttatgctcctaccatttataagcattaattttgctgaactgatatagtaaaaatgttcaaaataacatttggcagagcattttactctgactactcaagaataacctataatcttttctttttatactacatacacacacaccacacacacacactcatatacacacttacacctgtttttccaggatttacgtctttacctaaaattgtataaatttttccatagtcgagatgtataatttaaccttccctttcccaagggatgacatgtagccatttatttcaataagaaactccaagagcactagtattcacaagccaaatacagataacaccaaaatttttgctaaataaaggtgatgcatccattagcaaatgttgttgcttttaaagtgatggtttatatttaaaatccagtttaagttaaagttaggatatactgatggtttgcacatgatgagtggcagaataaatgagtcaaagttaactcagaggggctttgtttatttttttgttgttgttattttgcttttcctgggcatgtgggtaaatcatctccccagatgtgatgactgatgcttactgggcaacgaagagaaaatgtcacataggcattggatatgtgagtctggaactcaggggagaaataggggctggagttaaaaaacgtagagcctttgtattagttcgttctcacattgctaataaagacatacctgagactgggtaatttataaagtaaagaggtttaatggactcacagttccacattgctggggggcctcaggaaatttacaatcatggccgaaggcacccttcacagggtggcaggagaaagaatgagtgctgagcaagggggaaaccccttataaaaccattaggtctcagaactcactagtgatcatgagaacagcccgggggaaactgcgacccccactcccgccccgcccgattcaattatctccacccggtcctgcccttgacacatggggattattacaattgaaggtgagatttgggtggggacacagagccaaaccatataatccttgttgtggaaatgttatttaaacccacagactggataagctcaccaaaggcgtatgtgtacatggagtaaagggaagaatgactgaactttgaggcacatcatctttaaaagtcgggaaaaggaagatttaacaatgttgccaatgaaggagcagggaaagaagccacaggcagggagagaaatcagaaaatgaggacatcctaatggccaaggcgggaaaatatttcaagaatggagggatcaatcatgacaagtgccactgagaggtcaggtaaaatgagaactgagaattgcctgttggacacttaaggagaatgactttgagctttgtgaaataaaagcctgcctggaatgggtacaaaagagagaagggagggaagtgagccagtgagtacaaacaagtcttgcctttcacttgatcaggaggcaagatagcatattctgctacagatgaagtgaagtgggttgacttggtggtagaaggctaaggaagttctctcagcaagttaactaggtgagaatgaggggtgtgtgtgtatgtagtgccagagatgtggggagagaataaaaggtgtgagaaagtcacccttgataataagatagtaaattaaccaccaaaattggggccgccagtgccaagaactcacttgagggctctaattataaatttatagtaagaccagtcagcagagtcattcgtttttatctgcatcatgatacatgtaaggaggtgacagagatctgctgaaacccaacttgggattttgacaatggaaggacagaagtgtggggatgttcaactggatttatgtaaggtattataatgatgggaaatgaaatctaaatcagctaagaaagaaaatgagagcacgaggaaggttatggacgatggcactgtaatgtattatagtcaatggattggagatcccaagaggtcaagaaacaactaaagtgacagtgaatatactagggtaagaaagcttgaaagttacaaggtagtaaagtgtctgaaattgttatttttggatgtggcgtaataatagataacgatgagttctgaagtatgattaattaaggtaaaatataggacatgaacattggagaatggctggttaacaaactgagaaaccattttcatggttggaccatctacatgcttactgacatcaccaacaattatggcagtagccttatgttaaaatcaatgccagatgccaatatcatcagaggatggtggtggggaggctatcagaagactgtaaatgatggaaaccagaagcattcattgatagtgaagttttgcattttagggtatgaagaagaaaagaaggaaaatgtcttggaagtaacaattcggagcatgaattgtccctatacaaactccaagacttgtggcatgtggagaattaaaggaatagagaacaaaattcatcctttaatagggcttcagagaaaagttcttaggcgccaattgattttctcttcaagaagggaaggacatattcagagatgagattttcatgatggcatgccttgagtgccagagggtttggggagtatagaagatgtaggagcttgagtcccactaagggatcttcaaaatagtgtatgcttatgggaccaatgaatacagttcatctggaacacttgtgttccctgccgggattgataaaatacagggtctaatgggattgagcctattggtctcagttatggtggttcaaggggcagtcggggagggtgtgttctattataatcccattggagtaatggtcttagtccattttgaaaggtaaagcggagttggagaatgcgggtggttagtgatcacctggacatgtggagctcgtaagtaatatgggggctacagcgtgcagagtccagtgggcctacatttgaccttcctgtgagcagtactgaaggctggggaagacaagcctcaataacttgtcagactgagtcaggactgagattctcaacagtaatcagctaagaggtattgctctcctatcctaagagatgccttctttggcaagactgttcaactatgtctcattactaaaggtagacagaatcacttgggagaatccaggatgtggtactgttttgacacggtccaagctggatgatgtaagcaggagagaatgttctaccaaaaaccttgcaacatcagatcttcagctgtgcagccagtcagcacacagaagctaagctaaagagatgtggcatccccacagggaaagagaaagaagcattaggtaagcaactgcctcatttcccagcagtcatgaaggcagttttgctaagccatctcatagcaggttatggatcctgaatttctatgtattcccttagcccagaatcctgctttgcttttatgaacttaccacaaatgatgctcctgttctagagtctaggggagtgattccaaagtctggctgcagagtagaatcacctggaatgtccaaaataaaaatccagattctacccctgaacaattaagtcagaatctgtggggtcctggcttcagtgtttttcaaaagtttcctagatgattcttatatagagccgtggttaagagctatattctagggctcagattctgtccaactcctttggtttgacaagcaggttggctgctgctagaggactaacacttagctcctttctaggactttgcattttttttcaatgattcatagtcctcagactgactatcacatgcatacacgcatacacaaaactgtcctgctgtggtacaaaatgtgtgccttattgagtctcaatccagggacaattgcagcaagtgaagtttccagaggcctgggtatccataacacacacaggcatcccatccttgcagacagttcacacatggatgtgtgatccagtggcaggtctcaagaaaggaaagcttccaaagccaggagcttgactgagacagagccttgaggtcttggactggatctcccttccaggtacacactagaggcaggcagcttccttgtttcttcctctgctctggctgctgtttcattctaagcctctgcagacacattcttcatagctgagaaaactcacagatggaatgactattattggtgcttgtcaatccagaaataaaccacaatttgctcggcatttcaatctttaccactgatgtgttagtttcatttaattagttctgtgctggatgaggtcattagatttgcgtcctaatggaaacctattactcagctctgcatggtgaggagtgtgtaggactgatttgcattatctctggaaagaaggtgaattctctcactacatttgtggtgggcagcaggtcttccagcagaaacccatttgagataacactaattgaagggacacctgtcttttgagaattcttttaaaattttcatagcagattggctgtatgccctgagaaaagggtaaaaagtgtgctacttataaaacgcaattttggagaaaagatgtagtatgatagctaaaactgttacatgaatatcactgagtattttttaagctcttcctcttagaaccaaatttgaacaaattcttcccacacgttcttctagagttcacaaaatggaaagtggaaagtagaaatgaaaccacacctgtttccctcctggagtgagccctcattgaatctctgtagtagtgcctataagagtgcttttattttacaggggtactattatcattttcctttttcagaggagaaaactgaggcttcacactgtgagacctgaggcttcaagttactgaatattttgctcaagtcattgcttgtatcaaatggaacagatggaccccaaacccagtgtggctggtctgaaactttcctctttgtttttatactgcatcaaaaacagtttttcttgccctgatagaatctatgccacttaattctcaaaaccctgtcttcatcacatcccaccattctgaaatattcaccttcccttacaagataccaccatttgaaaatcgcaaaatatttttaaatctatcctctttcttatatattttttatcaagattccttctctggattctggccgtattatgaaaacagcaggtccaagtgtcattgggccaatgtaaaattgtgttgctgtattaagacatggacctaatgatcctggaaagctgagtgggtttagttatgttttgttttctttcctgtctaggacatcatgcaaagctagactacaagaaccagggattgatttcagtgtttctctgggggatggggtaatgggggatagatggtaagtctataatcaagaccatctctaaggaagaggattgatactctttccacgggtgacactgcattattttccatgtaaatggtgccccaagagtactatgggcagtcttgttgcagatctatttcatcttcctttcccctgccctcacctccctgctatttattgtttcccttcactgtcaaattctctgaaacattgtctgtattcaccgtgactcctttgcaatgcactttcactgcaatcctttaaaaaagtttgtcttcctcctacatttttctgataccactttctctgagaaattcaatgtataaatctaccagctcaggaatcccttcttaatttttctctgagactagtcactattttatccactctttctagaagttcacttctttctttatttttcagtttcactttagcctctaataggaggtggttgtctaagggccttgaggaggctgagcttgcacagtgatagttaattcttgttagtggctctccctctctagttcagcatatgctttcttttcctttctcataagtggaaacagtcataatgttctgctgttggatgtttcctggaaaagtctttggagagtttctcttcttctaagatttcagctaatgcactatgtggtatacagcttatctgtatctccagcctccacctctctcaagctctggccttccattggtcactcagtactcactgatcatctccatctagaaagccctgtggtaacccagagtcagccgaaatgaagacaagctcttcatctctctaaatatatttttgactctttatctgtagtctactaacttcatcatctatgcactagatagtagattgaaccagctgtaaactatgtctactagttttgtgcagtggttctcaaacttcagcgggatcaagaccactgtcatgatagcacacattgctaggtcccccttgagaagtttctgcttcagaaggtctggggtgaatcctgacaatttcatttctaacaaggtcccaggtaatgctgatgctgctggtccaaggaccacactttgaaagacacggatttcctgcacaagtctggagccagattgagttaggcttaaatcctaactcagccatgtgcttcatgtatgaatcttggcaaacttacatgaagtctctctgattcctcttctgtaaaatggggacgattaaagtatctacctcatagattttcttgtaaaaacgacatgagtatataagcaaagtgcttccaacagtttttggcagaccctcaaaaactgttagctataattgcacagcgtttactctctctgctttccttgtcctcactcccaacaaccaatcagctctcatgtcctaacagtctgcactctggaatacatccatttccttttcattattgctgtggatgggattaagtgtgtaatcacattgtcattcccctcactctactcatggtcatttaactgattggaactgtcactctctatccctgcttccccagacctcatactgttgtcaggttctaccttaatcactttaaagcaatcattacaaataggtcccttccttgcttagaaagtgaatgttgagtatattaatagggtatttgggactttccttgtactgagggcacctgggctgtctatgcatttcctctcatagcattcatgatatggaatctatgtttttgtaaatgtacctctttgctttcctgcttctgtaattttttacattatattcatttcttttgatatatactccccttcactattacaaggcagagtcttaattcattcttcaaggcctggtcaactttcctttgcccttccgaaggtatagcaaaatggtttcattcctcatgagaatgctgactgattgatggtagctgcttagagagatgacaagaattctggggccacatctacctgtgttcaatcacaaataatatcatggccagtgagcagtatctactgtagacacaggttaaatgcatggatgcatctgtaacaagtattgtctcttacgccatggagtacattttatactgtggatgcccaatgcattttggaaatctcacaactcagtaggcataacctgaattgtcaatgtgagtttcattttgattatgatagctaattttcccttcttcattccaggatgagggtgagaccttatctcagagaatgatattgccagccagaaaatcataataggcaatgaaaataagcctttaccaccttagttcgagaaagcaatatttggaacagggaaaatatattggttgtattggtggctacaggcttaggggtgaggtcttgggttttgaggtatagggaaccagaagaaagaataaggggatattctcccacaaggataaagaaaatcagagggttcttgggaatagctatttatagaggacttccatcatggagaactcctgattttacatgtgcaaggtagaaaagtgataaattccagctctgccacctatgagctatgtaattgggcaggtagttaactttttttgagcttcaacactattatcttaaaaacagaaatcatgatgctacctatcagggcgattgcaaaaattaaaggaaaacatatataaaacactttgtataatatctgactcaataattggttgttgttcttatgaatgttgtatggaataacaatcaagaaaatccccttaaaggtgttaaaactctttgcctcttatcccatattcctatattcaccgttagttatacacacataatgtcatgaagtgtctaaacaatactacaactactaactaattaactctaattgattggaactgtgtaagcaatactgctggtttactgttttcctgcaccaactagcatgagttgatgctgtgaaggtagagttttggtgctgctgtcatatttaatgcattcaaatttaaaagagaaacagcatgaatattacttagaaattcatacctttctaaggaagtttactctcttagattatcacactttataccttagatattttggcttatcttgttcttttcctgatgatgttattaaataccttgaaacacatgggttcataaatattgtaatttattcgttcaacaaatatttttggatgtttcatggggccaaggttctattctagatatcagagacataactgtgtacaaaacatataaacctactattctactggagattatcttctggagatagaatttagacactcaacaagtgagcaaacaaacaaccatgctgcaattttagatgttgacattttctctaaagaaaataagatgatggagtagagatgaccatggtagggtttgggtaatcatttttgaattgtggcgagagctttggccacatttgaattgatacctgcatgatgataaaggatgaagcaagaaaaaaatgtgaattctgagtcctctaagcagcgagaaaagcaagtgatccaactggcataaggactgaaagaagggccagttggtagctaccaggagtttggaaaggagtgttaaaaatcagtgctggaggggctggctgcgctgatcctggagggtgctggaagtcacctagggagtttggaattgcttgggtgcaagagaagccagtgaaacataaagatggtagcaagaaaaataaatttgattttccaagtgtacatgaacactgaatgcctgtagatctaaccttataaagaatttggtggctatttatgtagatgaagtggatactcacctgtgatttgttttctagattcaaattttctcccattgaaaaagcacagggtttacgcctttctactttgttgttcctgaattcaaaaacttttgagttcgtttttaatatattccatgacatattcatgtcatcctgttctctgacaataattttcagtgtggccctgatctgctacattatttatttctttctctttcccaaagctatcttgtgtcctctttgtatttctgtcttttatggacctgagaagatattaacgtagagattttgataaattgcctctgctgtccttggattacttcactttcctttagaaggctcgctatggccttaaaactgtgggcctgtttaaggttattaattcgttccagttcttggggagagcagcatgagcctctgcatgtatcatctggttgaatattctaacaatttaacaattgtcttttcgtctcttgtcccccacactttcaagttggggttgtcttttaacttcactcatagacttggacattcccttccatttcaaatagatgtttccaactcttgtgttatttctcttcttttattatatttgctgtatctacatattttttcaagagctgtacattactcttgactgttctaaattggcatgcctttatgttgacctcctgatcttcacctgtatacattatttgtcccaaggctttgattggctgcttagtcacattgagcacattcgctgaagctctaaagactcttctgtagagtcgacaactgtgtcagttctgtgtatctagtgccagaaaagtacaagggtgatgttttattcatactttgtgctttccttcacaatgacttgttaatttatttttaagttttcttaaatagttacattatttttatatgattcaagattttgaaaacattttttaaaatttaaaatggatatgattgaatttaattataacccacagaattttaatgggccatttgaaattgcaataattgaagaaaatgtttcaaaaatattttgagtgagcttttgaagtctctaacatacagtatatataatatccattttaaaaaattttcttaatgtgttgataatatgtggtttcttttacgaaaatactgtttttcatataaattcctagggagaactttgaaagaataatagtgattaaggaaagcatttaaataagaattaacccaaaagtagaagaaaatcagttaataaaaaacctagtcagagaaaaaatgccacaagttgtttttttcttctttgaaagaactttgatgatattctttcatttccccagccccagaaagaacaaagcttgtaggcgatgactgtgagccagacgaatcttgaaactctttgctcattcctcccaagtatcattcacctacaaatacataacttaattctatgcttctatttggaagagggaagctttaaaattattgcaaacgttcttgcaacggatccagttgcgcctgcctcattttccacctcctacgatgattatgatttcagagtggatttcagaggagaaagaatacatttctcagaaatgtcacttttattttaaaattaaaaaaatcatttctagatgttgcaattaatataaaataacccttcaagaatcataaaaagagaacactgacaaattttctgcaaatgaatgtgaaaaaattttagcatagcaaaatatggtggcagagtgtctacaaagttttcttcccatgctcatagaaacttcactgaaaattcaagactggctggaagattgagtgaactaaaaacctgcaaccttcttctaattctgaattctcatattaaaagaagaattagttgtcagatctagaatgattattagcctttattgctgctttcttcttaaaattttcacagtaagtagtttatttctgaataaaaatgaatgaaaattgctataatctattgtgtttggttattttatgaacaataatatgaatatgatgagaagtgtaagttacaaaaagagaccaagtcaaaatttaagaaacatttcattcataccatttatttagaaacactttctaattaattgaacactttattttaaagcccttggtgctgttagggaactgtaaccaagtccaaactggtaattagtaaaaatattaaaaactaaaattttaaattatttctcaagtggattcattttgttgtccctatgtttttgcatactatagtggtatttcatagggttatttcatcgtcccattaaaactatgctgcagtttccattcattacctcacttgatcagacaagacagaataaacctcttgcccaaagcacccaactagaaagggtgggagctgcccaattccaaacttcatgccttccacttagactagactctgcttcctctctctgaactcagttttcttggactgctagccttttccttttgtggaatattttctctgcctccatctagagtgtcatatgtagtttcctatatggtgaaaaataaaataattcaaaaaatgaaaggaaggttttaaagctccaatacagctttgaatccaataacctaacaatgaatataaacttttctatgatttaaaaagtatacttgtacatctattctttagattatcaatgttgtttagtgtaggtaatgcagatgctcagtctaccatcttgaattagaagcaacttatttattgcttaccagaatctttcctgagttgccaagagcatagagttaggaaattttgtaaacgtttaccttggacagtatctccttaggctgaaattacagtaggtggacagtaacaatatgatctttattttagttctttgatattggaatatgaattttctagaagggtcaaggcacttacatgacctaaaaaattagactctatttgttaataagagtctaacttatttcaaagcaaaaggccagtgaaggatcctcagggctggattaatgtgattttcagcacagagtgatgatggcaattatggtttccaaagcctgggagctgtgtgttttcagatgttggagagggaattgtttggaattcccaattccaaatgatttccctattgtttggagccagtagaaatactgactcttgtcagtatatttatttacaaagctcttgatgtatgcccactttaaagaattaactttcaaaaatcttaaagatataattggagtaagtttgttatatatgaagaaaaaataattctaagagttagaatataaaatgtgcagaatgtaactgtgcttttactttaagtttaggaggaaaacctaaacataacacattcttccaatgatattatgaatcatgtatgtcctgtcaaagaaaatgatcacttaatatgtgatattattaatgctttaatatgcaaatattctgcaaatgtcagtaactgaaggaaggagataaaatagtccttcaaaagttgaacatactcatacatactgtgcataggacacaattttaaataagattacgacctattcatttaatgacaacaataagttcgttttattcatcaataattcattttccaaagtacatatcatggctaaatattatttgaacataatggatacacacgagtaattgtcctgaattcctatataaatctattaacacaaagtagtaatgtaaacagtaaatacactacaaatacctgttcaagaatggccacactcttttaaaatattcatatattttgcatttagtttaaatgaaatctcattctacaaaatttgaataaactggctctaaaatgtacttcttattctcaattagaaatatagttcatgaaaagtgatttgtaaaaactgaaggaaaaggaatttttgtgttttcataagttattgtataattggctgacatgtttataaatccctttctccaggaagatgtaaaggaactcaacagaccaggttaacctgattcttctttgcattgtcacaaagaaatgaaacacagaattaaataaaataatgcaaccaatgttttaaatttttgcagtaaagaggtcaaaggagctcatctttaaatagaaataagcaccatagttttattctaactgcatagataacaatatataacttgtagaacataattttatgagttggtttggtggacaaatgtgtaattcttcttatgtggtcttatgtgggaccattcaggacaaaaaatgacatactgatctttatatttgcaatgcttaccatgtaatacacactcaaaatactttttaattgaacttcgtgtgtgtatagcacagaaaacttatcaaaccttaaaatgtagcagttaaaaaagatagtacatttccttccttagcattaggttaaattttaaactgttttaatttcctgaagtgtcttataaacttttagaattacaaaaaaatgtggtttttaataaaatatttttctccctcattattgaagacgatgttaccatacaactgagatggtttaaacttcagatgctccatagcagatatttgttttttactttctttcatgtcaggctgcttctttcaaattggtcattactagacattttcattgcaataatatttattatttttatgtcttttgaagcctttaacccagaaaggcctctaagtacgttttggatcataaaataaatggaaaaatctttaatcttaaataatcattagtttagcaaatatttctgttgatggttttcactggaacagagcttgctgatatgattgtaagtgtaggataaggccacccagttcagataattctcttccagagtaggacttctaagttggaaaacaataaagactataaggttgtttaaaaccatgcttattttacttatagataattcaggcattgacatatgtattatgtcatttgcaaatgatcattaagaatctctacttgggggatagataataataatcatatctttctcaataagggaatatggtaaaattccagatttagtagtggctaatgtaacctccttttcatggctctattcatgcctcattcctttcctatcatcctccatctaggtcactagcccttgttggagaatattgtatcctattgctccgtgctggtctgcttacctcatggccttaatattgttatgaccttgcaggaagctctcagtattctgtctaaagttgctcaaataatgtttaaatgtgcaatgtttatgctttagctggattccagccacagtgagtaacaagatccacatttttttcttcaccagaattccaggaagtggcatagtatccctctgagggaagcagtgagaaaaatggattggtctaccctcctcagcctttggagagctttggaggagtcaataagatgatagacttgatgttatgaaatgtgatttcttgccataatacttctcatcttcagtaacttcaaatatcaccacacactacacatctttgaggccaaagaaggaggaggtggaattcccttaccacacatatgtaagcagagatgaataggacaaaaattgatgaacgttttggggatggaccaaaacttgcccatcttttgaaatcacgatttacactaaaattagctaaacctccaagaaaatgaacagttacaagtgatggactacatatttttttttaaagcgttcttggtttctttcatttgactgcatgacactataaaatcacacaagctaagaccaggagaaggtgcgtgcagatgtgcttctgacttcttgaagacctacacatcttgctgaggaattctttgcttctttagtgagtggtgctgaatggaatgttagggctcctatagctataggggaaggttattttggggttattagtgatacctggtagctgattcctgattactctctcagactgtcttccctgtttcctctcttctgttgaaaatgttctctggcaggatgatttctgtcaataagagcaattggctttcctcgtcgaggttcgtgcaaacagaattgaaaaaagctgagtgagtgggcaggtttttgctggtttgtttaacaatgatttgagaactgaaactagagctgtctgaaataataaacaggtttctcagtgactggaagagaatggtgttttgttctttgttctggtccttttctcttttgacagtcctatatccttgactgttttcatggctctgtattctatacatggcctggaaatttgactgagggtctcatagctaaaaagtattagaagtcgtggccacctcctcacggagctctcttatttcctcttcgccttgacaacttctgtatttgctttaggtctgaactggaagttgcttccaggcttatcgcccaggtgagttaggtgtctgcttcggtttcctcacacagtattgtcctatgtgcttcttttacgatattgcacagcacatgttattacagtcatttcttcaacgtttgcttcctcatgggactgtgagttgtgtggatacaggagtcatagctactttgcttattgctgatctgacagaacctaactcaatgcccagtagagaaggtctcataaatagtcatttcacaggaagaaatggatttatttttggagatgtcattaccaaataaagccttctaggcagcagcgcccatgctggccatttgactcaaactgtgctgagggaagtatcccctggccttggaagatgagtgtcattttgattccagctctccaggtttttcatcaatgtcagcacctgctgaaaagaaccatcaaactggcactactgctgacttgtttgcaatccttttttaaagtttacctaaaaagaaaccataaaaagcccatcagattgtttttccaaaatccacatagacaataaaggcatttatctaaataatgttttggcttcacataacatcaataaacacttcatgaagattaaactgactgaaaaccttttatacttgtcaactgatttctgttggctgagttgattttctttataaagaatttaaaaagtaaagttgttttgcattaatgcacttagggatgtgtaaatgattttccttaaatcacatttttctgacaacgaacacggagtgaaagattattaaaactgatttctcatgaagttgtttgcatacctcaaacaaatatgtgaggctgtctccatcagtgaatgccatgtgttgatgtgattgatgaattataattaaccttggcaacatgttttacagcttaactttaaggatcaatcgaaattagttattctgaaagtcagtaaaatcgcttctatcctcagcttactgcaataagtaatggcctttctctggaagagttcttaaaatatagtgaacaaatacttagctattgaatctactttttaaaataaatgagagaccaatgggattggaataacttaatttgaaggagagaagtctccaggctgatttagtggctgttctatcaggagtttccagtgggcagggggatcagttctgattaacagttgaggcagttacctaattaaaacagggtgtatgaaagtaagggaagtgggatagtaggggtcagacatctaagaacctctcttccccctatccaatcaaagagaaaagctgaaaaaaatctttattttctgaatgtatatttaatgaaggtggagccatgtataacactaacattatagagtgatattaaatagggcacaagatatagatcacttaaaacaggtgggttcccttaggctcagcatatcaagtgacaattttttttttggtgtgctgccaactggcagagccttttgacaaatgtgatggaccttggaaaaatgataaatgtcttgaccttggaaaatccccttttggaagactttgtcctaaatgcttattcattataccctacagtaatcactgtcaaatatcaaaagatgactccttttatagctcgtgcaaagcttaaatactttagaacatgactgaagatgaccaaacacactctccagaaagttttagtcacctgaccatagcccctatgtttttgatggtcattgtaggcatttggaggtatcactttggacactctccttgaccttttctccgcaaggtctgtcatctccatttagactacacaaaataacgtaacttctctactcactcatcctgcatatcctctgctcccagtagggctctcaataaggcaattacttatctctgtattagcaagggggactctaattgcacctttgcatgaagcatgggcaattaactaaagggaagttgaagctttagtaactctccaatggcaatccatcctgtcctgtgccagcatggccacccagagcagacccatgcctgctttctgcggggggatgtgggatgtttggtcccagaaatattaaaaattactggtgttatctcataattgtagcctgattaaatagatcttattttttgttctatcttttgtgcaaaatggcccttgtacagaaattttctgagatactgaactatggaaataaccctgggattacattggtacttttctggactggaagacttggagtgacatgctgcaatttttaccaagttttgaatagatcatatggcttattttcttttaaatacttgcattgccgtagtgtaggttcctgagctaatttccgtctgggatgaggtatggtcttctgatgtccagtcatgggtccagatggtgatggtaagaaagatagcatgattgctgaatggcatacagaaggaaacagaatttatccctagtaaagagatggataggaacttactagaacaacaggatatcctcttgtgattaggagaggaggtattactcttcagcaaagacctggggtactagataagatgtattggcccggaggaaacaacagaagaagaaatctgttgcacagttaagctgctgtggttggtggttggtgaggatggagaggaatgtggggatggggtggaactgactccagggactcttttaataagactcaacgtaattcaacatgcagcttgcatgaggaggacagggacactccagtggctcctgtaattgagtcctgacagtgaatctaaattccattttacaccaagaaagtctagatggagccagaggtgctttccctgatatggccagatatgagaatcaagggagggcagaggaagatggagagagtgtgccctggcagctatcatctcatattctctggactttgtatttcccttgccccatgtcaggttttgtttgtttgtttgtttttgtctgtatcagtttttaattcatttttacattattcattgaatatattcatagagaaaggattgacagtagacatggctatttgttggatttcttctgtattttatatgtagccttttggtaacaagcaaggtggacatcctttgttttatttcacctaatcctaatactatgtattccaagcctgtgcttatatggctgtgggtctcaaactcatatatctacagaagtcaagcagaaatgtaaatcaggagcaggatagtgggggctgtgtccagctgaaggctgcttgcccagtctaatgaaactgatctagaggaggttgttctagccattttttctagaagtggacacatacgaggcagataactagattgttttaaagaaacattttaattttgaaaacattacatttatttatttatttatttatttatttatttatttatttattattttgtaatctggagggtttagctgacctctgggccaccaattcacctgcactgatgtgattgggagccagtgagagttgtggatctgtgtcttgaaaagtcacttcctttatgctagtgtagacccatcagtagtaggtcacctggaagccagggctctgcgtaggactcagggcagcaggactgaaagttgtgtaacacagcagttaaaaggagggctcaggaccagaatgcctgtgcttgaattccagtccagctactaaccagccatgtgaccagccaagttgatttatgcttctagcctcggtttcctcatgtaaaaagtggagaaaatataagtatgtgtttcacaaggttgttgtgatgattaaatgagttaatgcaaattagcgacaaaggtatgtatgcatcctcactgttaggaacgagggagcaagatgggacatggtggtcccctgagtcgcagtcagtgaggcagctgtgtccatgcctgtgggatgcttttccactagcacctccacaaaatttttaattcgaagggtaggatgagggatctgagattttaaaacacctcccaggtgacttctgcaagaaacacctgcagaggagagagagcttggtcactggggtccgatcctggccccggtgtttactaacagtgttgccttgggctgatgactcatcccaatctctttggtttccaaacgttcactaatgcgatctgctctgtgaggctgatcatctggcagagctcatggcacttaacacagactctacaacacgagttctcctgtcttctcggtcttaatctagtgcaagtctccccaccaagacttgggaaacactcctaaggaaacaaagaggaagaaagtgagatcccaggggtgaagattggatcctttgtgtgcttagttctgaagtggaatcaaatcacttcagaagttggttgtgtgttggcctctggtgaatttgtttcacaatgccatgtaggagtacatccgtggcttctcatatttgtttgcctaactataattgagcagcttgaattcaggctacatttttaaagaaaactagtgatcatattcacatatgatgctctggcagtacacagagtcaagttttcactggaaaatagctattaaaacccagcaatgtaagttttcctatgcaaccttgatttattattttgtcaaatatagttcaacctatatatagccagttaggagcaaaggtgtagggtaggaaatctctagctcggttcctatagtatccaacattctataagaaaacatgcacacacttatcaacaggttttcaataatgaaggcaccatacaacccatgataattatactaaatatactgatgcttatgattttctcatgctgtgtatctggaaggagcctggtgtccagcctcatactgggtcatggaagtagcctgttgtgtctccgtgttctaccatttatcacagggcatcatttctgcatctcgagtcccaattcacaaaattgaaagatctctcaggcctgagcctattgttgttttatctttgaatttttgacaacccagaacatgccacatttcaggaaaggtttcttgaatgagtgcataaatgaagctttgataatgatttgacatttcagcatcttctggtttgctcgtagtttgctaaggaggaaaatgaaaagagagaaagttagagagagcattgcgagcattgcgatttccaggatatacttttataatgagttgttccaatacagactgcaagctcagaactttgaattaactggcacccattgtatgccacctgatgttagtgacaaatgtacccacttcagaacaggagccaatatctgcgtatcagggagctgcagagatgacagtgaaaaggtacatggcaagtgatgaatggtcagatgctaatgccagcaagccctttgctacagagatggagagtttaattgttcccactttgatttcataccgcagacgccataaacatcttagtttaatcaaccagaaacatgggctgtcatagatttaaattcatagcagttatgggtctatatcaaaagctatagagatgcttgttacacacagatacaagaacaggaatggaaagcactgatgtcatccccatgggttaaactggactatctgtctatttttcctgcagggtgaggagtttattaacaagaaacagtgtttatcatactaggcattcagataaatccattttccatttaatttattcatttggaaaggtcaacttttccaccaaaacaatttctgtttctttaatgatttctttaataactttctgtatttttgtttgtatttctcttctctcatttaaaaaaatctcttttcaatatgccaatttaattttagcacacctaatacaaatggcattgaaaaacaggtttcttgagtgtctttttttctttttaaaattattctcatcacttcaccttaggatgttttgtaagcgcatcacatgtgtttcatgtgaacctcactcagtactggatctttttctttccatttacatcctaggaagttattgtttcccattccaatactgtatgcatttttctttcctaattggcgcttgctagtagacagaaaaacattacgtttaaaatccatttggctttaaattaatattttagctgtatctgaattatcccatgaggccatatttatcttggaaaacagattgtggttaaactcctgtttctaacttttatttgtttggctgatgccatctttctgttcagaaaaggagttagggcagttgtctccttccactaggccttgaatagcaaatgtttagccccgagcaaaaaaacataactgccttctgagatgtttcaggctttcattcatgctgtagatgctaattttggaggaagacagaagcttatattcacacagttactaaaagagcacctgggtcagggggtggagactcggtttaccaagttcttaaaagacaacatggctcttctgacttcagcagataaagaggaatcggggcattttcattcctggatcaatcccacttcttgttcatatggtctgtttattgcaccagccattaaccaaacttatgataggaaagtgcagctagtttttcaaaataatgttttaagtcttctttttaaaaaataaccaattcccccaggatataatagtctaattaataaactgatgaatgttataatccattagacagcattatcccgagatggaagggataggtattatttaataggaatgtccagagcagagtttatcagtactttcttgtcacatgaaagtacagttcctggctcagaacacacgccaaggctggtggccagagggaagaaagaagggaagaaaggagggaaacagttgaagccactggctgctttcttctcaagagcatgctttctgttcaaagcacttagtatgtttgcctccaaattctgaactcctatgacttcctgctaaagcactcaccttctttttatttagctttccaaccacaagtcagagctgccctacctcagaatagagcttctttattccttcaaattcccaagtttatttacatggaaggggcatactgctcttgttagaagaatattaagaatatccttgaggttcccaagaattgtacaaataactgttgattctttggtgatagacattctgattttcaacatagaatggctatgcagagtagagggtgtctgttatgtgttgattctacaaacagaagaactaaatccacctgtgtgttcagttttttatacctttatgtcctttatattcccaatgggggtgaggagcgcaggtaggaagggtaagagtctaagaaattgtgctaaaaactcataagcttttggtttcaaaatgatttggcaaaggaattttatcctgagggacctgagtttggggtaagttttaaaggaaaatagtgaaaaagtagcaactatagattattagttacatttaacatttcatgatgggatggtggtgtgtgtgtatgttgacacataatgtgtatgtgtatatgtgtttgtgtgtggatatatgtaggtgtgagtgtttaaggtgggagtcttttgactccagcttttatcattgaatgcaaagggcagaggaaaattcacacagataattcgaagtttgaacatttatattttttgtctttatatctcatattcctaacatgggtaacaatgtgcagacaatttaattcttttatcctcagatataagcatttatttatttttatttacttatttacttattttgagatggagtctcgctctgtcacccagactggagtgcagtggcatgatctcggctcactgcaacctctgcttcccaggttcaagcgattcttctgcctcagcctcccaagtagctgggactacaggaatgtgccaccatgcccggctcacttttgtatttttagtagagatggggtttcaccatattggccaggctggtttcgaactcctgacctcgtgatctgcccacctcggccttccaaagtgctgggattacaggcgtgagccaccgtgcccagttagatataaccatttcttataggaagacacaatctttgttgaagaatactttgaaagaactgcattaaggaaatcctgatctgggactcagggtgtggcacctagggagcaagtgagaagagttaattaaagtactgttatagcaacagaactgggcagtaggaactgcaatgtcactgagaagaggaaggaggataatagctggctgatagagtttgatatgtgtccccatcaaatctcatgttgaattgtaattcccagtattggaggtggggcctggtgaggggtgtttgggtcatggggcaggtccctcatggcttggttctgtcccggtgatactgagtaagttctcatgggatctggatgtttaaaagtgtggcccctgccccacaagtgctcttgtgcctgttttcgcctgtgacttgcctgcttcctgtttgttttctgccatgggtaaaagctccctgaggcctccccagaagccgggctgatgccagtaccatgcttcctatacagcctgcagaactgtgagccaattaaacctcttttctttgtaaattacccagtctcagatatttctttatagcaatgcaagaatggcctaacactcagggtgagcatgaacaagcagggagggtcaaagaagaggaggtctttggtaggagtatgggtcagggagtggggtgagggtgggcagcatcttggaagagggtagataatgcttctctgagatttctaaaatatctttagtttttattgttcatgatctttcttataagagaattatttttggtagactcaaattcaagctgtgttctgggttcaggctggcacagattaaaaactgaagctggtgaaggagtggccacagctggagggaccactgggattctgttttcttgagactttggtcccgacctatatggtgaccattggtccaacataggttgggaccaaattctcaagaaaccagaagacatggttcctccctcaggttgctcacagcatgccatccagtggtcccttgttgatcatgattatcgggagtaaattctgtgtcaacaaagttgacctggctatatttaattcacccccaaatcaaggccagtactcaagtcattttagtaaatttctgtggatgcagtactacagatatgtgattataaggggagccccgatggggtcccatttattcctttatgattaccaggagaattgaaaggcagatctttttttgatgaatgtgaatttctcttactatctgaattgtggagcccaattccattcaaataaattatctatagatttactgaatagggaaaataattttactgtttattgagaggctgttgtatgctacccttttcacttacattaatttatttaatattcacaactctcctgagtggctattataattcttattttattactgaagaaactgaggattagagaggttaagtaatttactcggtattattcggttagtaaatgggaagggcgcaaagctcagaggtgtgtatggaaaagacattgtttttcctgggctgtagagggctggaagtgctttcactgaggctcaggcagtaggagccgggcagcaaggaggaggcagcctgaacatgggccaggatgctgtgccgtgtgggatgtgttcactcagtcaacaaacatttattgagtgcctaccacatgccaggcaagtaggcaaggtatgcctaccacataccacatactgctccaagtagggtggataaaaaagtgaacaaaagaaatcctctagaactcacgatccagtggaatgatgctgtcacaaatgcaatgacactgactcaatggtttgcagcagcacccagaccatctattgttgaggggtttgacattccttctgatgactggcacatcggagcatgctgacttatctgcctacacactgtgttgtgaaacacacgattgtgagatggctcatgagtaatttgtcacattcctacgtatcagaactggtcaacctataaatccacgtttggtcactttagcattaatagacatgctgtaatgactgctggacttgggcacctcttcccaccttggacaatgatttgtaagcacctgtatctttagtagaagtgctgccacttccatccttgatggccttgatggcatctttccaggagcactgttctcttctaagtccatgctgctccctgtacttcttggcttttctgtggtataaggtcccagggagggtaggacattgactttttctctaactctttgctttagtttctaaacctttgtctttgacttcgctttctgattccacccttcacgccatcagctctagagacaaaggtaacaggacaaagaatcagggaatgaggtgagtagtacctgtctctctgtcccccttttctccccctcctcaggcaaaatcccttccctccttcagctgcaatgagacatcagaaagggccaacgacttactagttatcttgtgatccatttaggaaaagagcaaagtaattgcaccatggttagaatactcagtatataaacaagaattcaagttctaatatctgcgatagacttattaaagaaagaaataatagtagattagattgaagtttatccttataataacttgtctcttgctctcttgcattcacatttgttttcttgagatgagataaaagatttaatttactgagaatttgttatgtatgaaaataatattcatttcctccagcctttcaatttttttgtcacgaagttttgtataatatatacctttatagacatattttcatcttttctacatatgtgggaatgccaaatgaaagccatttttcctcaatataacatttttaacaagagttcttaaaataatgattccccagttaatgtatacatatacatttgcaaaatagcaagttcatttggtaattgcagaagaaataatggctttaataaccactgctccacttggtgtctgcctctaagcattgttaggacagcaagcatcaggcaattccccatggccctgttttctgagaaggttctatttatgtcttccgaattttgactatattttgacattttcaagtaagtgtatggcatctgttgaataaatgatcactcaaaatggatttgcctcaattatcacctaggctttaatctctctaactacaaactcccccttcctcactgttgctggcagtgacacctgcattcctgctgcaccgtcatccttgggaagggctttggagttgcaatcagcatccttaagagaagagtacttaggtgtagtatgctttggctgttctcataagtcgttattggtcagcctgaagcctcactgttacaattactttgtctaattatgatttttgctgtcaaacttatgttaaaatttcagcaataacagtttatttgttcagtgctctcactgcattataaacatgaagttttcacattttgtatgttttagtaatcatgaatgactttctagtattgtccacattatatatttgatatctatttatactgcgaattaacactgaaacaatgaactaacgtgattttcttgaagacaacacattgtgttcagttggttctctgaaccctaaataaagctgaaaagtgtattaattttggtatggattccctaatgattgcacagttacttgtatatattttatagctgtaaatcttggtggataaactagaattagcagtgctcaatgacttcaaatgattttttttttttttgagatggagtctctctctgtcacccaggctagagtgcagtggcgcgatctcggctcactgcaacctccgcctcctgggttcacaccatctcctgcctcagcctcccgagtagctgggactacaggcatccaccaccacgcctggctaattttttttttttttgtatttttttagtagagacggggtttcaccatgttagccaggatggtctcgatctcctgacatcgtgatctgcccgcctcggcctaccaaagtgctgggattacaggcgtgagccaccgcacccagctgacttcaaataattttaaagattatacacacacacaaacacacacacatacacattatttttcttttgaactgaaataacacctggtttcaattgttatacatgttttctcagctagtgctattgcagttgaaccataatatatataaagacaatatgtggatcctagaggtaataaattatttcagcaaggttgtagagtacaagattaacaacacacacacacacacacgcacgcaccagtcacatttttatatactgaaaatgaacagggaaacaaaaattaaaaatgcaatagtatttataattactccagaggaaaagacgtgattagatgtaaactttaaaaaacataatctgtacatactgaaaatttaaaaatgctgacaaaagaaataaaaaacatcttaaataattggagagacatatggtgttcatgtactggaagtctcacatagtaaagatgttaattctcctgaaattgatagtcattcctataaaaatcttagcaagatcttttgtagataagcttattgtaaaaggtgcatgacagatcctagaatagttaaaacaatgttgaaaaataataaagtgggaagaattactttgctgaatattaagcttattatagaactacagtaattaagacaatttggcagcgagagagacacaaatcagttggacagaatagaaattctttaaatagattcacaccaatttgcccacatgatttttgacaaaggcacaaaagcaattcaatgcatgcaggatacaagtttcaacaaatggtcctggagcagtcagatattcataaggaaaaacaatcaaacaaacaaaaaacccaactgaacctccacataaacctcacaccttatataaaaatcaactcaaaatgaattatcggctggaaacataaagctataaaacttttaagaaagaaatacaagagaaaatttctgggatctagcattcaacaaagtgttcttaaacttgacaccagactcaatacataaagggaaatgttgatgaagtctactttatcaaaatttaaaatgcttgtctgagaatgagcttgttaaaagaatgaaaaaacaaagtaaagactgggggaaaatatttgcaaaccacatatctgatgaagaataagtatttagaatatataacacagtctcaaaactcaacagttaaaacgatcccattaaaaatatggaccaaacacattgagagacatttccccaaactgaatatagagagagcaaataagcacatgaaaagatgttgaacattattatcattaggggaatgcaaataaaaaccacaattgatatcaatatatagctatcataatggctaaagttaaaaaaaaagaaaaaaggaagtagtgacaacaccaaattctgacaggcatgcagagaaactggacctctgaaacatggctggtggaaatatatttggtacaaccactctggaaaacagtttgccaatttctttaaaaaaacctatccatgcaaatatcatatgacacagtacttgcactcttgcatattaacccctgaaaaataaaaagaatattcacatagaaacctctacttaaatgttcatagcagctatagtcagactaaccaaaaattaaaaacaacctagttgttctctggttgttctttggcaggtgataattaaacacactgtggcacatgtatattgtagaatactactcaataaaataatgaactgttgatacagtcaacaacttaaataaacctagatggaattaatgctaaatttatcaagccaattttaaaaggtcacatacttcatggcaccatttatataacgttcttgaaatgaccaaaatatagaaatggaaaacaatgtgtagtttccagggtttaggcaagagttcagagtgggagggaagtgaggaagcttataagagggatccttatggtgaaggaatattctgcatcttgagggtgtcaatgtcaacagctttcttgtgacactgcattatagttgtgtaagatattacctttgggagaactaggtagagctacatgggatcagtctattatttcttgcggctgcatgtcaatctgcaattatctcaaaataaaaaattgaattcagacaaaagaaacaatacatggaggaggcttttggcccctgtgggagtgctctcttgattctcctgttagagagagaactgtcttttcaggtacaagatgggctcctcagcctccgtcccagatggtctacgttgagttcaattttttgttaagtcaagaagatctgtacttagacggcagtataaatacttggcagacactgcaaaaatgacctcagtacatacaatatttgtcagaaagcttgcttggtatcagcattgttcagaaaaaaaaatacttgaagaccacaattctaaaaacttatctctagagcaagcctagagaggagagaactgagtgcctaagttcaattattattgagccatcatgaaattgtgtttacagaatcacactttggtgatcctagaagaaatatcttcctttagtcaaagaatgataaaatttctctgaggcattaaatttcctatgggaattgtgaattatatgaccaatttttctccttctcttaggctactgaaattctacagctaatttgatttattctgtagcaatgtgggggtcattatatatgattgttcaggcatgaccaactatttttccttggttccccatcttacctttaattaatgtatcttgttaaagtttctgagtctttagaagctgccttaaatctctatgtgaataaataaggaataaagataaatttatcttgatgtacctgcttcagcctcttaatatctcgtaattgcataggactgtcctggaagcatattgaaaaattaaaacaaaaaaagacttctatttctggaatttttctatgcctccttcaaccttgtatttagcaagcatatttttgcaatttttttttctttctctatcttgacttcctctctcttgttagccctctgatgaatgggccagtttgaatttgctactctggtttttggcctttgacaacctgccagcaaatgccccgcttgtcctctcaccaaggatgagaagtatcccatcctatgctctccctcagctctaagggatttactcaaaaagagaaagagcaattaggccctggacatgcattctaacttaattttagcctcagtcttctctgatggaaaccatgctttaaacatttcactccccactaaactcagttcatatcacaaatcctcttcaaaataacagatttatttaaccttaagtaaaattaaccttggattgatccgaggtgaataaagcattttagttataaatggaaagcattgagtctgccatttctagacccatttctaagatgcctaggatgcattagataatttatataaagtgatgttgtgtaactaataaacacatattctactgatgaagtgtgtgtgtgtgtgtgtgtgtgtgtgtgtatgtgtgtgtttgaaagtttggcagttacacatacagtcatatgccacctgccacctccgtattgtgctgtaagacttcttcagtcatccttaaggaagtgtttgatccctctttcttgttacatataaagacaatgcactttaaatactactttaaaatctgcatcagcgttatatgcctgcttggccctaggctccagcttcaccacatgattttctctccaaatgaaatatacacactaccttgggttcttctgtgatttttcctgtctactcacatttctttatttttcactcttggaatatctgaattcatcatgcataatttctgctgtttcatgtacttgaggaatgcaaatatttgagatctgcagctacagacaaatcaatagccttgtggttccatttgttcccttctagcttttaattctgatttttgacagtttctgaatatggtaagttatagccctgcattactaagagcaataaaatataaatatatcaattcctaatgaatttaaataacttgtgaaataaatcaaggagcccggaaaatttaaatgataaaatttaaggatgagattcatgtgctatttgctgactaatgtaaaaaaaaaattcaacctgtttatgactaatgttaaatcttaaaatttaaattgcacatgaccttggtctgttttgtttcactatgattatgactaatccctcccaaatttataacagttgaactaatgcaatgttgactgtcaacagttgaattcctaaaacaaaaataaatatgactcgtttcatttaagatgtagatgggattccatggaaaaggacaaagatggatgattatgctgtaatagaattggttggttgccagcgataagcttcaatataagagtggcaggtgcattgtagtggaatgaacaatgagcctagtgtcaaaatctctaacagtatgacctcggtggagcctgtttttgttatcgagggtacatttttaatagatgagcccctctggggtcttgagtaaagtgaagaatcataaacacattcactattagaatctgagggactctgtcatgtcgtcttccataccgctggagctgggtctgcctagttcccgaaatggacactccaaaaatatcttataggaaaaataaagaaaattctttcttcctgtgaaacctttcagccctctccaattattgtcaaatacagtgattttattcaggaggattcagtctgctattttaacctctggctttaatgctaagtattctagcctaatatttatactatgtatattttctcaacgtcatctaccagtcagtagggtaccttggtattcattttcttctgaatttatttactaattcaacaaatacttattgaattgtttatgtggcaggagcagtgctaagttctgagaacccaaaagtaaaaaaggacaaaaaaaacccctattttagggagctttaaaaattacatggatacatgtaaaattactatagtaagtgctgtgaagaagagatcctggtgcagtctatgcatataatggtagcttttactgatcatggaggtgagaccaggctttcctgaggaagtaattgttcaccagtatctaaaggatgagcatgagtaactcggtaaaaggttgggcatgagcatttcaggtgaagaatatgacacgtgaagcagtcgtgtgtttgagaggggtgtggtaaatgtaaagtcagtgtggccgcagctcagagaggaagaggaaggctggagaagtagtggtgctactaatgtttaaactcgtcccaaaggcaatgagaaaccatcaacgtttattaggcagggttgagagtgggtgaagtgacatgatctcttttgtatctgacaaaccatccttccttgcatgcggagactggctgccttggtggatgcaggtggacaaggcagccagtggagtggttgagagaagagatattcacggctaagatgatggtggtggtggaggaaagcaggtgacacgagtttttattggaggataaatttgcttaattgttaatttaatttatttttattgataaatagtatttgtacatgtttatggggaatatgtcatattttgaccatgcatacaaattgtaatgatcaaatcagcatattcaggaaattcatcacctcaaacattcatcacttctttgtgttgggaacatttcaactcttttcttctagctgttttcaaatatacaatacattgttgttaactacagtcatcatattgttctatctaacatcagaacttattccttctatatgagtgtatgtattttttttttttagatttgggggatatatacatatatttgtttgttaaatgggtatatttggtgatgctgggatttggacttctagtgaacccatcttctaaacagtgaacgtagtacccagtaggtagttcttcaaccctttactccctccctcctttcctcccctcttttggagtccccattgtctattgttttcacctttatgtccatgtgtacccattgtttagctcccatttatacatgagaaaatgtggtatttgattttctgttgatgcataaattcacataggacactggcctcctgctgcatccatgttgctgcaaatgaaatgactttattctttatggctgcatagtattccatggtctatatgtaccacagtttctttatccattccactgttgatggatacttaggttgattctatgactttgctattgtgaatagtgctacaataaacataaaaatgcaggtgtctttttgataaaacatttttttttttcttttgggtagatactcagtagtaggattgctgggtcaaatggtagttctattcttagttctttgagaaattgaatttgagaatacatttagcagggcttggagagtgggagtttaggaagctgatggtgaggatcagggcagatgactgccagtattgcttggaatatgtaaatcaaccattggagaggagggcaacatgtataacattataggagcttttgactggtttctctgcttagtagggaagaaaattcagaaagaacaagtgtagctccccgattctgactaaattcacccataagaaagcccctaaagttttctgacccttcactttgctgatgtattttatgcatatgaaatgatacaggtgaaaactctttgagatggatcataatgtataaatataggttattataacatattataaataattgtattacattttatatattaagtatacatatgtatataaggcatatgtgctattgcacttttttattgtatacattgtattgtttttttccttcaagaagttcatagaatgacaatattattttgtattaagaaaaaatctggaccaggtgtagtggcttgctcctgtaatcccagcacttcaggaggccaagacaggcgaattgcttgagctcaggagcttgagatgaacctgggcaacatggcaaaaccttgtctctacaaaaactgcaaaaaaattagctgggtctggttgcatgtgcttgtagtcccaactactggagaggctgaggtgagaggatcacttgagtccaggaggtggaggctgcaatgagctatggtcttgctactgcactcaagcctgggcaacagagtggagattctgtcaaaaaaagaaagaaagaaagagagagggagagaaagagagagataatgacagagagagagcaggaaggaaggaaagaagggagggagggagggaggaaggaagagatggagggagggagggaaggaagggagagagggaggaaggaaggaaggaaggaaggtgtggaatctaatcctcagatctatttcttaactatctaaaagtagtgtgttaatggtgtgatgcttatttattaaaactgaatgaatggatggtaattttgttaacatttagcttttaaaatctagtgaatatatgagctcattttactatataacacatttaacatttataattttattaaattgcaaacagactcgtaagtagacttttcttctctgtacctttggcaacatatttagaaggcagttaaccatccattgagatggaatataaagagtaagtctgaagtttacatttagattttgacagtcatcattagattatgcaaataattaaaaaaaaaccttacctcttgctagtatctgtgctcagtgtccttccaactccattcctttctttcatgttaacatatcaaagccaatgaggaattctatgctgtgcacagaatgccttgtctacctatggcagcaagggccactctgggatatgatatagtggaaattaaagaaaaatctgcctttactccagttttaggatgttttgaggagaggaatgtagattccatcttctcatacggaggtgttcattggggttgtgggagaggccttctgtagaaagagctgaggtcggctcctcaaggagttggcatagcaggctgcccagaataaactgacacctgatagattggagtgttcagagagatggaggcttccatggttttctgaccctggaagtatattgagatccagtgacatgccgtgggcccaaaggggagcaccccacccaccatggagattgggtttaaaatgatgggtcagcttctagacaaaagacctggcaaaaacttagggatctgcagccaagtgagaggcaagaagagtggctgagtcaaggatgacaagagggctgatgttccctgaggtcagaatggttgacaaaataagggattggagtgctgttctaagcacttaacacatatttagtacacctaatctcttttcgcacctatgaggtaattactcctaaaacttccattttgcaaatgagaaaactaagtacagaaaggttaagtaactttctcagtatcacacagctaataaatggtaagccaggatttgatgtagaaatctggccagcaggctgtgttgcaaccactatccatgagcacaaaatccacgagccatagcgaagaggccagcatttttaaaaatggccaagtggaccagggctccaatccagccctgttttttttttttattgttgttgttagtttgttttgtttttttgaataatgctttactgaaacaaagtcatactaattcatttttgtattgccagtggctgctatcctgttacaatatcagagttgagtagttgtaactgacaccctgcgggaggcaagacctcaaatattcagtatctagcccttgcagaaaaagtttgttgactcttgacgtgggcaaaaattatcaaaaccaccaacgagaagcactcaatgagagacaagggaattccccaattccaagggatgcaaaaaaccatcaatgtattttagatgactttttatctgtagaagcagaagagatcattttatccatgggcaaccccattatacctgaaaagacatttaactactggctcggcctaaagtgtaaactgtaaaccagattggatatttaatcaaggggctcagaaaaaaatgacaggagtacacgtgtacacgcacacacacacacaccatgtgtttgtgtatatacacacacaaagaatgtcaactatatatacaaataaagaagtgtaaacacattgttagtttggggattaatatttgttatgagttagtatttgtcttatgttaataaagaaatatttatttgagatacctgctgaaatattgatgggtgaaattgatatgctgtcctgaatttgtcttattatagcaaataaaatataaaatatgtttgaggagtatggtgcaaaagaatagctaaattaatgatcattgttgaagctaaagtgattaatagatgatggtttcttataccattccttttacttttgtgtgtttgaaaatacccataatcaaaagttttaaaaattgcaatgtaaattatttagacagttttcatattttaccatgaagtgaatacagaaaaattaagtgatttcattacactcttgccataatgttcatcccttattttctttgtactatcgggaaagaactagtgaattggttcgaggcatagctaagaaaagaagatgagacacctattggggagttaaaaattacttaacaaatttgttttgccctgtttgccgtcaccacaaacatgaactgaagtgcgaggagtggcaaatggtagggaaatttatatctacagaaaatcacaagctaataaagagttccctaatggattctcttagattcccagtaggtagattatgaaatggttgaatttcacatcaaacccattggaagggtggcagatactctctgagttaaaaacacacacacacacaaaaacacctttcagcctggtgcagtggtgtccacttgtactcctatagtcccagctactcaggaggctgaagtggaaagattgcttgaccccaggagctcaaattcagcctgggcaacctaccaagacccccatctttaaatttaaaaagaagaagaagaagaaaaaaagaaaacaacttttaaagataatgttcctgtccttaaaatgaggagattaaatgtgcattaaaatatctcttgcagcaagtaatttggatatatttcatcaatatgtaatatttgtgctgtgttttaacagtggcgtgtgacatctgttgaaataaaagttttgttatgtcagtcaagctgacagtaaaaagactgcagaacagttttctgacatgctgccctaccaatttagccctggcactataatttccattttgatttccaatttgatccaatgattatgcattcctgcattcttaattttcaagtgtttatgatttctcgatgtattaaaatatttatgtctctatttgaagaactaaaattttctatgaataaatagccatttattcttttaacaaatactgtcttgtgccaggcactgttgcaggcacgacagcaataggaaggaacaagacagaatcctactcttttaaatgaaattgctgctatagtattcactacaatatagggtagatgaatttatctacatcctagtatggtttctgtttactgatactaatctattctgaaagaagcaaattaaaatctcccactacaattatttttatcacattttctttgcattttttgatttatacattcagtttccatttttatttatatgtatatgtatacacatatattcctatatatatatatatatatatgtaaatagttgcctttatttttaataaagaagcactttaccctgattgtacttttaagcttaaattccaccttgtctgaccctgatattgctaattatgttactgttactaacttttgttttggcctgctgtattgttgcccaggcctttatttaagctattgatcatcacatcacttttttgtgtatttctttttggaaataacaaatggcttggttctgtttaacaatcttagttaatagactaccttttgatatgaaaattgactccatttagagaaaaggtggcaatatgtgtaatttttctctttctgtttattttatgttatactttttactgtatgttttcttttgccctttcctattttttttttcaacttggtcaaaatactatttttattttcctacttgattgtttagcagttctgtttttgactccattaaaggttaccatctgcagcagaaaaagttaatgtagtactttacatgaaatttttgctgaaacctgtatttattttactagcattacttatgtaagaaaggaagaagttattgcaaaaaaaatctatatcatacccacagttgcatatagcaatttatattaaagttaattacaatttaaacgtccattcctagccacaatttatcagtaatcatacgtgtttgttggctaccatattgttaatagtgcagatttagagaacattttgatagtcacataaaattctgctgaacaataatagtatactttgtataaactatatataccatgtatatactttgtatactataatgcatacattttgtaagtttgggaggtaattgttagtaggttaaatattaatgattaataaaaagttcaatttcctaatacaaacatgaaagggcaatacaatttcacatcacagaccttttaaaataacatcagagtttaagtgaggattatttaacaataaattatttaagttaatgaaggatatcccaagagaacttcttgcaaacaaactagccaggactcaatttcacgatgacaagatttcgagtaactttaaatgtgacaagaaaggacgtttgccccaatgtgtctaatgcatatacacttaatgtccttaagatattggacttgtaaatagtctgaagcttttgccattatttcaataatgggtcctagtgtctagcttaaggcaatgtattcttaaggcactggtgtcaatggtttttctgttttttaagatgattcattatctgttcaatgaaacatgtggcctccagtatcaaccacaattttatctgaagttggtgacaatttggaaactctacattgtatttcacttttctagcattaataatcaaacacatatctctctactattagatggaaatatctctattttcttcaccaaatactttcaaggctgtttctcccactcaagtaagataaactttaaaataggcttgatgttcactccatcttccacctcaaagcctgggttttattaaaatagttcagtagttctatagtccagaatactttaagattatcctgtcattacacctcttaatttgaaaaatctcatatatttccagatagcctatgcttattcatttacatactactgtgcgtgtataaacacacacacacacacacacacggaaggacacacaacctaccactcttcccccttatcctctccaattcatctgaggactctattatgatttgagtggggaggtgttcttatatcattccttgaatattgtcatctgatgtggtcagtgactgataaaaatgtttaaagtcatagtctttgtaattacaaaattagaaaaacacttaaacactgttaattagaagatgagtataaatgcgctgggtaaatgtgctgggcacggtggctcacacctgtaatcccagcactttgggaggccgaggtgggtggatcatgaggtcaggagttcaagaccagcatggccaagatggtgaaaccctgtctgtactaaaaatacaaaaattagccgggcgtggtggcgagggcctgtaatcccagctactcgggaggctgaggcagagaattgcttgaacccgggaggcagaggttgcagtgagccaagatcacaccactgcacaccagcctgggggacagagcaagaccctgtctcaaaaaataaataaataaataaataaaaaagaagatgagtataaaggaacttggttccttccttatggatgtttagcttgtttaaaatgttgctatcacaagcaatgtaacatgaatgacattgtcatttcctgtgtaggccagtatgcctaggatacaatcccagaagtagaattggggtataagagtgtgggtttgtatatttttattagatagtgccaaattgttttacaagggtttctacaatcaacatttccactagaaatatatggaaatccctgtcttcctgcaacaattttggaggtttggatttttagagccaatctgataggtaaaaaattgtatcgctgtgcaatttaaacttattttttcttattttgaatgtgactggaatcttttcatatgtctaagagtcatttgcaattgctgtttcataactttctatttcttagcccatatattttctctgaccattgtctttttcttgttttccgggagcacttgacctattagaaacataaactctttgcagagtaatttatagataaaaattatttttccagtttatcatttgtcttttgattttacttgcagggttctttttccactgagcattttgaaatatttttgtagttgaatttatttcttctttatttttcctttctctctttctttcttttagagtttctggattttgagacattgtactgtattggtcaggataggtgaggttatgctattcctagctcatgtggttgttggcagaattcaattccttgcagctataggactgacatccctgttttcttgttagttgtcagcctggggctaatatgaattcccagaggaccatgaaattccctaccatctttcttttgattaccttaaaaccaactgatcagtgactttaattacatctgggaaattcttttactttagccatataatgtaatccaatcatgggttgacattccatcatattaacaggttccctctatactcaaggggagggattataccaagaatcttgggagctatcttaaaatattgactatcacagatcttcttgaaatttctcatcttctggtttgcatgtttattaagtcatcagattcctctttttttttttttttttttttttttttttgagacagagtctccctctgtcgcccaggctggagtgcagtggtgcgatctcagctcactgcaagctccgcctcctgggttcacgccattctcctgcctcagcctcccgagtagctgggactacaggcgcccaccaccacgctcggctaatttttttgtatttttagtagagatggggtttcaccgtgctagccaggatggtctcaatctcctgaccttgtgatccacctaccttggcctcccaaagtgctgggattacaggcttgagctaccgcgcccggcccaagtcatcagattcttaaagcaggtttataatgtattttaatatctgataggaccagctctcttgttgcaattcactggcttatatttatttgataaaatttccatatgggttttagaataaacttaccttgttcaaaaacccctttagagaattttataagcatcatgataagatatacatgttaacttatggaggagtggcatgtaagtgatggagaggtttccttttcaataaaatattgaatttccatttactcagactcctttggtttcaattaatagctttttaatttttttcttattatggttcttatgttttatttgttttgagatattttatctttttgttttgattacatgtggaatattttactaatatatcctataggtattattattttcttaaaagcaagctactgaattcagcatattcattatatacagtaatttttcagttcattctcttggattttctacttatacaattctaactgctgtaaatagtgacaattgttcctcctccttaatttttttgtacatccaatttctttcattttctaactgactgctactaaaatataattttaaagaatactggtgactggggatattgttttcttcttctcaccctagtgggaatacctgcaaggtttgacattaaccatgaagctattctaggctgagagagatatatttatctgggaaaagctagtatccatctgttactgttttattgattttttaaaaataaataattattgttgaactatgccaaatgtattttaaagcatcagttgagatgattacctaatattccttcttgaacttattaatatgactttatataaatagatctttgattattgaactatgcttggattatttgtattaacacttgatcatgatgtattattctttttacatgctgctgcattcagtttgctgatactttatatggggctttcacattacaattattaggtaatattggtgtataatagatcttgatcaggtactggaacgactattaataaaatatttttaaactaattcaaaaagtgttcttttatagtctaacactgtttgaataatatgataatctactttaaaagtctggcagaattcggccgagtgcggtggctcacgcctgtaattccagcactttgggaggccgaggcgggcggatcacgaggtcaggagatccagaccatcctggctaatacggtgaaacccgtctctactaaaaatacaaaaaaaattagccaggcgtggtggtggtcgtctgtagtcccagctaatcgggaggctgaggcaggagaatggcgtgaacccaagaggcagagctttcagtgagccgagatcgcgccactgcactccagcctgggcgacagagtgagactccgtcttaaaaaaaaaaaaaaaaaaaaaaaaaaaaaaaaagtctggcagaattcttccatggacacattccatcctattgctttttttgatgggacagggaagggttctttgacaacttcatatattttgtctgtttagattttgaatcttcccttagtgagttttggtaaattgtgtttttctagactattattcacttcatcaagctgtagctctatgaagttttgatatccagtaccagtctttaaaatacttgattttaatttgcaatttcctctgacataaagttacaaacttaattttttaaattcctagttgtcttctcggttagtcattaatttcttattttatcactttttttgaagaatactctgtgcattttcatatgttttgggtgctattgtcaatttttgttaatatccgataggcacataaaaattgtactctctattaaagggcaaatgttttatacacacacatatatacataatgataaacatataggtgtggtatgtgacatatctatatatgtcaatatgatctatcttattatttattcttttccatatttttaagtccttttattcacctgtgtaattatctgtgagagataagttaaaatcgctcattaaggaagaggagaaaattaacttggttctttcctgttcaaactcatgtttacttttatgattaagagacagaatttgacatgaagtcactggttcatatttttttcattgtgtatatcgtaggttgttacattatgtggagaaatccaagattagtatgatattttcctttttaaaaattcggaaagatatattttgggcaatgaggccaaaattatcaagtcatttaaaaattccaagactttaccaggatgtttcacagtgttgactatttgaaccagtttcctcaagcactaaaacattttcaattttgagtcatcttccttatttttcaacattttcttattaaaatatctgtaatatttattaggttggtgcaaaagtaattgcaggttttgccatgggccatttttccctccaatttcatcttttttttttcctgtcatttaaaaaaatcttctattttaattattttccctgaattttgccagctaatatttagatggcatctctggatggtttcactatttttttcacatttttttttacatttatgctgtgtaggtttttttctttataaatgttattacttcgttaatttattatgaattcttagctaaacatttggatacttttgctttatatcagtatttctcacttgtgagtgatctacatcaaatgataaattccaatgctatttttgatattttttcttaaaatattataaattctacttagtttgagggctacttcctcaaaatctcatctcttattccaaacaagaagtatagtttttgaactccgagttggccccttatcttcaagaaggcattgatttattgattgattgactgattgagacagagtctccctctgtcgcccaggctgaatttgggatgacaggcacacaccaccatgcctggctaagtattgtatttttagttaagaggcagggttccaccatgttggccaggctgatctcaaactcttcacctcaagtgctctgcctgccttgacctctcaaagtgctgggattacaggcatgagccaccatgcccagccagaaggccatttttgatggggctctctgagatttttctgcttctgggctctcttgtaatatcccgtatggcttctacttgattcagctatttttggaagcccttactgatatttttgaatatgcagattggaattgtcacctaatgtccctgaaaatggattttgtgtatattaacattgtttgtgctgcatctttatgattaccagaaaaattatagggaaaaactagacatatgcagccatgtttataccaatattcctcctgttttttagttcaagtattaatatgtaactctcagaagctgtattttattaggatctttcctgaatgttccacttgctctgattttctctggctgcagggcttctcacatgtgctaggattttcttttctcagctctctgggactcaggctgagctccaccgtaccttaagctagagccgtgcggtgggtggcaggaagtgctgtggtttcctccacctgatatagtgaaagcagcgtgggttctctactaaggagccaggagaagcctctgttttccttctcttccagaggtttcagcctaaggtataaacaagacttatcactggtttatctctccctcaactgtttggaagctactgaaatcaggtatactcatatggaatgataccatcatttttcttcttgggatccatactttaatgcaagacaggtcttgccaatatccactactattgccctccccttggaattctccatcattaattcctaagatcccgtcaagctctgaatagagaagctttcgggactgaaggagagcacagatgtatttaagccacgatcgcccattctccctcctaattttgcctatgaatgggttttatacaaattgttatgagattgaagaactagtgaaaaattaattggtactagtttttaacacacttctctatacttataaacttccaggggtgaaatttgaaaggaaaatatttgttctgccacttgtagtatttcaaagtcttgcagtattttgaagtctcctagttacattgagggtgattatacttcattttacaaattgctttgcattacaaaaaaaaaaaaataggtttacagtctcttaagaagcccttcactgattggctaatggtttctgatggtctgtagggtctaaatttgagcatctgggagaataccactttctctatccaagctgcctagctgcagggaaaagagggtagacagtagcctgacttccagggaaatcatctgtattgcaggttagggccaaagtaggtcagtaagagtagggaggctaaaaaattgactgaaacaaagaggtgagtagcaagcaattattaggagcaaaaacaaagtcctggaatcacagtgtcggggaggtaaggatccagggtgaaggtgtgagcaggtaaattggaaggtgttctaagccaacatgtaaactcagcatctgccaatgcaatttctcccaatactgtccttccttgaatgtttgttagcttattattttaatggcaacatcagcttcaacctctccttgtctcttaacccacttaaacaatatgtggccattctatctccaaattatttccccaaccacactccccttcctacttttgctgtaacttccttttccatcctccattatgtctcctggaaaattgccgtcattcccttaactggtttcttcagaagcctccagtctctccctcccatccatccttctcaatgctgtcagagtaatcttttcatgtaagagtgacctccaattgtaagcgcgacattgctgcaatatcatttatctccatcattattgcagtttgtattttgcgattggaaggatggggcaggcaccaaaaaggtgatgtgacttgtgctgtattttccgagtaagtccaagaggtgaattatggatttttctaccaggctgactcaggttgaatgctgttcatttctgggtttgtgtctattatcctgcaaataacgaatacccctaaaatgttagtgtgcaattatgccattgggatagaataattctctacaacataaaacagtttttatacaactatgaaagtagtctggagatttcaactttcattcaaacaaaattgaaagaaaatgaataacgttgagacaactgagcacaaaagaataatatcgtattttccaaaatatacacatcaaccactttaggctattgtatgtgaaagggccgtaagggtagctgggtagaatatgcccaaaatttcttccaatcatttttttttcattgcgaaataccgtaagaactctatccagggagggcgactacatttttggcagggacaagatacaaaaactagagagatagttgttcattctttgagcagcaataaaaaattcagtcttgctctctctcttcccctctcttccctctctcctctctccctcattctactcccttagaatacttgtaagatgtcatatgtaggtaaaaggaatacatcatcagacaagtatgagcactggaaattagccaatgtagccaaacttggggaaatttatgtgttgcttactctaagattgaggcaaatgagagtgacagttctttccagctcctcccctgattactgatgaggtattactctctgagttgctctaagattgagccaaatgagagtgacagttctttccggctcctcccctggttactgatgaggtattactctctgagttgctctaagattgagccaaatgagagtgacagttctttctggctcctccgctggttactgataaggtattactctctgagttgcctagtagtaaagaggaagtgcggtcatctagcatcattcaggaggtgaatttataatggttcctcattgtttaaagcaatcttttatttctattaaatgtctatacttttatctaaaataatcatctttaaataactgagatcatacaacattccctaagtgctcctgtgtagcacaatgttatgacctcttctcttgtcttcttctcttctccacctgtatagagatagtgacaaatcaagtcaatatctgtgaaacaaatgttctcatgattggtaaagcactcactggctgtgctgaaatctgggtatatttatttttcattatagctaaataaaataaaaaaccgaatagcaacaacaacaacaacaaactcacaaaaatctggaagataggaatgttcagtgtggcaggtaggatcaggaaagcagatgagtaagtgtgctcttgctgaccgatatttaccaagcactttccaggagccagatagtaggtacactccctgcattaactcatttaatactcacaccaaatctatgaaggagggtttactattgccaccactcccccagtttcttatagacaaagaaactgaggcatagagaggttaatcattttgcccacaatcattcaagtagtaaatggtagacctgacgttcatttcctgtgatcttgatcctctccataagatgaactcagtcttatagatgctttttcaaccacctcatcgtgattacagaacattctggctctattactttgaacaaattattcaacctctctgccaactcgggacaataagacatatatgacacatgatcttcaaatgtgtgaagattcagtgatgtaacaggtataaagtgttcagcacagaagcctggtgcaggccaggcactcactaaatattggttgtcttttagagtgattttcttctacctgaatactcctaagcaagggtattttcttctttattttatatcagtgatagttaacagagggcatctcacacaggaaacgatcaaaagaaaggaagaattagagggaaggcttgatttacataagtgttggaagctggcgtttctgaagaggccattgaaggcatactgtcatatctgagtctataatgaagaccagaattttagcaaataacttgagaaagtgtccaagcaagcagcaaaacttatccctagaaaaactcatatataaaaaggttggcagaaaatctgaaatgccatcaagcaggagataaagatttggtacatttccatggtccattttcaatctttttacctgtatcttctacctcaccagctcctagctcctgccgtgaaagtttgggcctgaaaggcaagaatgcaatgtgattgtattcacaccaaattgtaaatgttgggcttctgttctttccttagatttgttttgattttgtacttggattagggggtattgcaagatggcacctagtgtatgaaagctattaattgccaagtaggggcaaaagatcaaaaacgaaaaagaaaaattgtagtaaaaaatctctttagcaagagagcttagataaattacaactcccttagagctttcttttttttttctatttgtacagcattagtaatttttgctcaatcaaaagactatgctgaataaatggtgttcatgaaaatggattgataattgaaaatggattgataattaattgttggctgtcaacggtggctcatgcctgtaattccagcactttgggaggtcaaggcagacggatcgcttgagctcagtagtttaagaccagcctggccaacatggtgaaaccccttctctaccaaaaatactaaaaattagcaggatgtggtggtgcacacctgtagtcccagttacttgggaggctgaggtgggacgattccttgagctatagaggcagaggttgcagtgaaccgaggttgcgccactgcactctacctgacagagcgagaccctgtctcaaaaaaacaaaaaaattagctgggcatggtggtgtgtgctggtaatcccagctacctaggaggctgaggcaagagaatcgcttgaacccaggaggcagaggttgcagggagccgagatagtgtcactgcactccagcctcggtgacagagcaggactccatctcaaaaaaataaataaatacaaataaaaaataaataaataaaataaaaataaataaatggaattgttgcgattatcattatgattattatgtcatcttttagttgagccaatcctgaatgtatttaatgtattagtcctatgctttaaggcagggcttggcttgtgctgcctggacaccaaaggtctcagatgccatctcctgaaatgaccctacccaggacaccaggaaacagctgcatggccagtcctgacctctcaaaaagcaaccgtagcccataaatagcctgatgatggatgtgggaatgagctgggacctcattcccaggtcagattctatgtgaatatgggttctggtttccaactatgtcagggccagcagatatgagtttgtgtactacaagtcaacatttgggaggcctttgtagagctgactccacatccattttatcctctctggcgattgaaggcttgggggaaaacagaagaatggctaaatgagcagtgctaagtcttgtatgagtaagatggaacagttcaagaaagacaattctatgtgcttgagcatcatctctttgattctgacccattttttccactctcctgttttaacctgtcttctattaaaaaagaagtgaattaaactgttttgaaatatgagctctgctacttactaaccagctatatagccttgggcaagttacttgacttctcatttagttcatgggtaaagtagaggaggatcataatagaacctactcaggcttctaaggagaaacaagataacctagcaaagtcctcagcacagattaaataataaatattacctcttgtgaatttttcatttgtaaggaagcattttatcccctattttctctcattagcttgacaacagaactttaatccacatgagttgatgccctataatagaggagttgtgggttgatgttattttaaaattctaaccacatttcctcatcttttgatgacacttcaaacttttcattcattagcttggtattgtcaaggcttctaaaattgccagatgtcaggttttaatttgcagggaccccggagatcatctcatccaaccctctcagttttatagtgggaaattaatttaaaatttaaaaaaaaaatgactgacccatttgtttccagcattctgtaactgcattaaaaaataaataaataggccaggcacagtggctcacgtctgtaatcccagcactttgggaggccgaggcaggtggatcacgaggtcaggagatcgagaccatcctggctagcatggtgaaaccccgtctctactaaaaatatttaaaaaattagccgggcatggtggcgggcgcctgtaatctcagctactccagaggctgaggcaggagaatggcgtgaactggggaggcagagctttcagtgagctgagatctcgccactgcactccagcctgggtgacagagcgagagtccgtctcaaaacaaataaacaaaaaaacaataaatagcaataaaagagttcacgggaggtaagctgccccaggttctgtcccaggtcctttggttctgtccaaaatttatgccattggttatgtcactcttaactctctaggacctcattttttacactataaactgataaatttgacaatctctagctgaatgtatatgtgtgtgtctatttacctgtatatttacctgaattatggtaataaatatagatacagatttttgttataccacccattatcagcataatgcaatttccatactgtatttatggtccatggttaaaatgatgtgtatacacatgtgatgttttaatatattagagctcatttcaaagaaaggcagtgcaaggtctgttattagcaatgtgtggggtcttttaaagtcaacacctggtgaaaatcctcactgcccggagtacttttgaaactccttttctgagccctttgtggagcctgaggcacactgttctcatgctgcttattgaacagcagagctgatctttgcctttcaggaacgatttcagttttcaaaatagcctaaagtaaaataagcatagcaatcaatatgggcaaaactacatttagtcaaaggccagctgtgtctagcagataaaacgacatgatcttcttgtgtagatcttacactgaagctggcaggaaattagaaggcagtggctgctcctgtgtgaatagtgcctccaaaggtgccgtctttgaaggatgacattactttgggaacatgggtgcattctgctaaaactgtatgattattatcttatgatcgtatctctgtgtcaaagacaacagaatcatatacgtttgttgttttttttttttttttgagacggagtctcactctgtcgccgaggctggagtgcagtggcaccgtgtcggctcgctgcaacctccgtctcctgggttcaagcaattctcctgcctcagcctcccaagtaactgggattacaggtgtccaccaccacacccggctagtttttatatttttagtagagacagggtttcaccatgtggccaggctggtcttgaacttctgaccttagcctcccaaagtactgggattacaggtgggagccactgcgcccggcccatatatgtgatttttaccatttgtccatagtcgcaataggaaggatgagggagatttttggcctagcataattattctaaggaaattcagttctgaccacaagcaatggtgttgttagtgtgagaacctggtgctgtgactggggcattccctcagagacttctacttgtgccttctctctcctatgtaggagatctcaacccccgcgaaaagagtgcattgcatttttactttgaagaagtttgagaaagaattacttacaacattattattaagaacttagaagaatattcaaaacactcctataactaacgtaagattatagcaatcaatgtgctggaatacaaggacactctggtgttgggaacgactgcattaacaatcataaattaagtatacaatttgttttgtcccccagtgaattctatgaggagatatactttaaagccagtcctgttgaaaaccctgatgtcttatgaaaaaaagtagaaaattgaaagaacactgacctggatttcaaattcagtagctgctgcttttatttgaacaaatatttttgcctacggacccttttttccccctcctggtaaaatgaaggggtgggaccagaaaccttctttaagtgacagtccactgtggcccgcattacacataaggccttgctcctggccgcacttctgtcatttgctccattttgtctgacagaaacgggctaagatttcatttcataaaacaaaacaaaaagtgtttctacttctaaaaaggaaaaagttgaaaatctcttcccaagttcccttatgtccttgttttcctgtagagaaggtggtgctttcatctttcctaggccgagctgtaggttcaattttctataatttcagaaaagcagagctgggtttacctatggagcaagagaatcttggcaggaggaaaccatggagcagattccaggcttcttactcagcactgggaggcgaagaacttgtcacccttgagaccctctcctcttcagtctagctcatgtgttcagcgtgcaggtcatttgtgccaattagcttacctttccaatcagctggttgtgacctgtcattgttgccagctcccaaaattggaaggttttcttcctaaaatatcagtcctatgctttccagaaaggtatagaatgtgcagtgtcttcacagcctgtagaatgtgtaatccctcaagtgagattacagaagacagagatttcaaattcaatatgtctaaggtagaatagatttttttttttttttgctgtaacaggcatgaatttcgtgtttcaatgatacaacagtaatctagtttgccaagctaaagatttggacactattttattttcctcatctaaatgtcagatccaggaagaaaatgaatttttttctctttagtcctgtcctcaatacctagaaaggtatttggcacattactggaatgacatatttggtgagttaatgaataaattaatattcttctctttaggtcatattctacatccagtcttcaagaattgtctatgtagtttcaggtcttgtttgcaaacccttctatcctttcagtctgtgctgctgctcactgattgttctctttcttacctcttccttggattatcacaattttctcctaagtcacctactttcagctgcttctggccaataggctctccatactgcttcaagagtgctggatgaaacatagcatatgatcatgtttgtggcatcacaggtggtttatgttcttagagctgtcgatcaagaaaaataatgagacaagtctcaatcattttaggaagaggtttatttgccaaagttaaggacggatcctgggagatgggtctgtgcctttctctgaagatgattttgagggctccaaatttaaagaggaaagggcaggatattgagaagtagacaatttcatgtaagaggaaggcagggaaaaaatagtcatctgtgcctttgtctggctcagtgaatctacatttttttttttttacataagatgatatagacaaatgaggcagagtaaaaattcagggaatctgcattttacataagataacatagacaaaatggggcaggggaacaacgagatatgcctttgtgtctggtgggcagggggtgatagtacctgtaaagataagctatcaatttacattgctatggcaaaaatttaacagaaacaccttaaatgatcttgcagctcactaggaatttcctcatgggcaaaatttgggtggggtgggggcataggggggcatgtagctttcatcttgtagccatcttatttaggaaccaaaggtggaggcaggtttgtgtgacccagttcccagcttgacccttcccattggcttaatgagtttggggtcccaagatttaatttcctttcacagagtatattttccacattccctgtgatgtatgtatgtaaacaccatacacagaggaaagaaaagaggtttaagattaccgtgtttcactcctctatgaaattcttagtcacatcccgtgatccttaatttataatccaaactcaacagggcatgcaagtttcttcaggacccttctcgtttgcatctgacaacttttgagtctatattctggccatagtgactgtctcgtggccctcctcatgcatgacttgtggtccacacaactttcatccctttgcaaatgctgctctctggacacagagtctttcagacagatccactgctctttgaagactcagctcatatgtcaccactcttctcactgttgcctctgctcagcccccacggcacagaacatgctgtattgtagcaaaatcaggcctctttacctcacaaatagaaagtgaacatcttgaaagcaagggcaatatctagtttgtctttcaactcctgctttcagttgagtggcagctcaataaatatttgccgaatgagtgaaaaattcacccagcaaccacattatgcctcttgggaaaagtaactcctaaagagtgtctttataaataataaataccaggcttttccttgtgcagaaaaaacagacctcccaaacatgtttattttggtctaatacacagaagtgtatattggtgtgagaacaaaaacccaccaaatattgttataggaaacatatcttactgcaacccagctgcatgctctgtgactttaaaatacatgtttaaaatgctttgcaaaattgcagcatctgaaagagaagtacaggatagtggtgcacacagagctggccctgcagagctggctgctgtggggagtccccttggttacatcttcccatctgtacagacagcagcaggtggaacctgagctgttccatatgcggattagtcaatcgctttttctaaaggttccaagaggcaagcttacattttgtcttcagatctttatatgaaaataccactgtggataatgaggctgttgtatgcataatttaactttcggaagcctaaattccgccgaaaggcaaattggtacctagaggcatgcaatttgcatggggatttcaagccctcctcctatctattgtccctggcatggtgttgcttttcttctaaattattttcccttgttctttgaatgcctaattctgagattgtaaccagattaccatgggctccatatttaatagtggtttcagaaacctgctgagcctgctttgaccatttctgggagcataagttggggtttggcaaacctctgccagcacccagaggcagtctttctaatgaatctgctccttagcctgcagcccacctgcctggagagggttaggaccagctgagcctgcagctgcccagagtgggaggagctgatggagtcctgtgtggctgacttcacagctcaatctgtcaatccggttggggacagatggttagagaactgtctgtctgaattgcctcagaaagaatttggtttcttggctgcatcttcaagtcatggtccactttcctttctgctctggactggagaatgtggctgtgttgggaagggtactaactctacttttcaaagcctttcagagtaaggatgtgtgtaagtaaatcaagggctcaggagaactaactgctgattgtcttctgatatttcgtgtgtcatctaataggcaatgtcgattttgcatgcagtgcacaggagcatacctgtcaataaattctaactgctcagaaatgatttcttctgagtagcatgtttgtattttatgaaggtaagccatgaagacccaaagatgtgccaatatgtttactgtaaccatattggataattttgacatatggtgaccagggcagtttacagatgactgagaagttctttcctgatgcttagtaaatacctaagtcatttgaaatgccaactagaaaccaaagaggaaaagagaattggtgtggaagaggagaaaaagaaaagaagaaaagcgagacagagaaaagccattttacctaaaattggaggtctatttcagatcaatttttagatcaagagatctaaatctgggtcagaactcactgaatacttagctgggtgaaattgaccaagtcactccttcattccttaaaatgaaggcattggacttaataatttctggaggtctccttgaaatctaatattcagaaaatattttatttgtcctctaaattaggttattgtagctatttcaaagatgactggggtatgtacactagccagaaacagggtagcaggtctggggtagagacagaggtccaagttccctgtgatatggacaacacataaggaaatactgcgtagaagagagtggttccccagcaaagtccccaaccccaagcctagaaacctgtggccttaaatgggagctggtattcctgttttcacgcccaaatgttgccttttccaagaccaatctggcttaccatatctgctatactttgctcatataaaccccaagctccacgagcagaagagcacgagagctccatcacctttccagctcctcatccattctgctgggagtcacctccatccagcaataaaatcccccgcatttaccatccttcagtttatccatgtcacctgattctttctggatgccagacaaggacccaggtaccaagaggtcactgagctggttaacacttaagctgtctgcagatagcagagctaaaatagcactgtaacatgccccctggggcgtcagtggttgcaggcacccacccctagatgctaccttggggctggagcccaaaagcatttgccctggctcctgcctgtctgtgtgctccccctccagtaaagggtttgagcgcatggtggctgaacaggtaagccacacccctgtcacacatcctgtggcaggggtgggggtgggggtcagggaactctcctgtttcacctgcagccccccaaataattatcattctttgagttcttacaatgtaccaaaacctgcgttgagcaccttaaatacattaccttgattattccttaaaaccacctgcgacgtgattattgtttcccttcttgtatgtctgagaagataatgacttaaactgcctcaaatcccttcatccagaaatgggatgtcctgcattttgaatctctgctttattctacctctataaatgtctaatttgcctaatagtgatcccctggttttgggttttgacaagataggggcccacctaccatttcctcggctattctatagttgtatgttataaggagaccttaaaataaagatatgatttgtcttgctaggagcaaagcatgtatgcatagctcatataagaacacatttctatggagataacattttgaaccaaagtggctttaaaaggcagcagagatgtgtatatttcctgaaggcatagaacctttttctccctctagttaacatggcccttcttttcttaagactgacagttgtattcttgttgggcagtcactagaatttgttctgttgccagacctcctggggcatcaaagtgctgtctgaattagagaataatggcatgatgaggtcaatgacagctctgaaaatgacatgttgccatagtggtaagaaaatttcaaaaatataaagaactccattatcttatgatattttattagtatctattctcctggcatagtacagtttttattcttctaggaatgggttgaataagttgagtccactcttatttttatgatctaatgcatagaggcaacatcaaaatacgaatgccttgcaaaagattgcctatgttgtgaaaatgagaagatgtagttgttaaatgcccataataagtcaggcattgtaataatttataagagtggataaaaatactagaattaaaatttaggggtttttaaaaattcctttttcttcacatctgaagtgtgatattgatctggatgtgtggttgactccaggatggtgaagaatatgtaagtagggattgtgataaataaagttcaaataatatgagattaaaaaaatctttatagaaaaggatcagggagatttgaatacaagagttatattgtttagttagttctagctttccaaagattttcagtagattttattaaaaggattatgttccatattagctttttttttttaaaattttgctttgcagacatttaaagtgatcctgatattcaatggcacatataaccttcattgatttgctttccagctctttgtgactttacaaattcaatgcatacaggtaaagtgtaatcaagttattaatctttgagaatctttatgtactacttataacagaatcagttcttgtgactcagtaaggaaggcaaacattttcatgaattgcagtctgtagaggagaagagtagtgttgattgtatttctttacttttatatcacagagttatattacacccagtcatttacatttgatgctatttgatatgataacatttgctatgtgaacagaattgtagaaatcaaaaatcatttaaaaagagtctcttcctcccagtcctagaataaaacagttccgtctggcgtactgttattcagagccttctgatgaatactatgttactaacgggtaagaataaggagaagaaaaaggaaaaaggagaaaaggtaccatttctgcataattgaaataaaataggaattactgtgggaagtatttcctggatgttccacaagaatttattttactttcagtctctaaattatgacagtgttgcttataacctttaacagttggattccagatgtcctccatttaacactgttcatccaaacatgtgtacacaattggcatatctactttttatcatgctgtgataaacatcatgtatttcaggtactgattcttttttatacatcaaaactgcttcagatcagcagaactcagacacagtgtatgctgggacctcaatagtgtcagccagggtggggcttagtcatggttcaaagaaaaataaattgaaataatcgtatgtttttcttaaaatatgttaatattgcatgtaaaatcttcacatacgtgggataaacctcacttggccatgacatattatcctttttttttttttttggattaagttcactaaaattgtgttaagattttttgcatctatgtttatgaagaacacttgtatgtaatattcttgtagtgtctttggttttggtgttggaggaatgttggcctaataaaataatttgggactgttccctcctcttaaatattctgaaagagttttacagaattggtgtttttttaaattacatttatggtagagttgccgagtaaagtcatctgggattggagttatctctgtgggaagattttcaactacagtttactgatatagatagttcaataattatatataggaaaattccagttatctatttttgaaaaaccttctatggtttgatgttttaagtattatttattatttatttatttatgagacggagtttcactctggttgcccaggctggagtgcaatggtgcgatctcggctcactgcaacctccacctcgcaggttcaagctattctctcgccttagcctcctgagtagcttggattacaggcgcctgtgaccacacccagctaatttttgtattttttgtagagacggggtttcaccatgttggccaggctggtgtctaactcctgacctcaggtgatacacctgcctcggcttcccagggtgctgggattacaggcgtgagccaccgtgcctggccaagtaatttttctgtttcatcaaagtgtttgttggtggtgacataaatttgttccatataatttcttatttttaaaaatacctctacagtctgtagtgctgtcatttctctcatttctgttatcgataatttgtgtctacttttttccctaccctcgtcactcttgatagaatcaattttattaatgttctcaaaggatcaagtttttatttcactagtttttctctattgattttcatttttccattttaaaaaatttctgacttcattattacttttttccttctgcttattttgtgtttcatttgattttccttgtttttcttttttaatatggaaaataagattattaacatgaggtgtttttaaaattctaatataggttaccagtgctataaatttcccaccaaagtcttacttttgctaattcctacaaatattgatatgctctgtttttattttcagtttaatatactttctaattacttttatattattcctttctccattggttaattagaagtatgttagttccaaatattttgacatttccctgatatcatttacttattgatctctaacttaattccactgtgttcagagcacatgcattgtatgagttgaatcattttaaatatattgaaacttgtttaatgaacccgaatatgatctatcctagtaaatgtggcatgcacactagaaaagaatatttatctgctgttgttggatggagtgtactataactgaattttttcaagttggttgacttttgttcaagttttctatatctccactgatttgctatcttcttgactgtcaactaccaagagataagggttaaaatagcagattataatggtggatttgtccatttctcccttgcagttctattgatttttgcttcatatattttgaagttctgtagtaagctgcatagatatttatcattgttatgcatccttggagtgtttacccatccctttatcattatgtagtatcattactcttttgttttctttcttccttttttttttggagacaggttttcacaccgttgcccaggctggagtgcagtggtgagatcatggttcactgcagcctcaatctcctgggctcaagagattctgccatgtcagcctcctgagtagctgagactgcaggcatgtgctactgtgcctggctaatttttttgtttgtttgtttttagtagagacaaggactcgctgtgttgcccaggctggtagtatttctctttattcctcaaattttggtgattataaagtctacttggtctgatgatagtgtaattactccagctttcttttgggtattgtttgtgtggtatatctgttttcatttatgcttttagcctgtttatatattttaaagtgggctttttgtaggcagcatataattgggtcttgctttttgatccaatatgataacgtttcctttttttttgcatttcctttgttgttttcttacctctatttctttgttttattattttcgtggttgctttatcattatttgatagttttagtatatacctctagctttcactgtcaagttgcaagtaatattacatcacttcatgtgtattataagaactctgcatagtacacttcacttctctctcccctcctcatctttatgctactgttatcaaacattgtatatacatatacataaacatatacatatataaataaacctcacaatactttgttactatttttgctataaacagttgattatatttggaatatttaaatgaaaagatactttatatttactcacataattgccatttcccatgctctgtatttctttgggtagatacatatttctggctgttaattttcttctgactgaaggatgtcctttacatttttttgtaatgcaactctgttactgctggattttctcagctgttgtagccctataaatggctttatttcacctctgtttttgaaagatacttttgttgagtaaagcattgtagattaacttttttgtttttgttcttccctttcagtttcttaaagatcagctctattgacatctctgttgcaaatgtttataagaattctactgttatcattacctttgttttctgtataatgcagctttttctgttggtcacttataagatttacaatttatcactggttttcaatttattgctgtaaaaagtttattatgatgtgcctttatatggttttcttcatccttcttatgcttggaatttgtcgagcttctcaactctatgggtttataattttcatgattttttttaattgactattatatttgaaaatagctttttgttctcatcttcttctggaactctacttctacatatgttatatgcctaatatatactttgaagtcgccccatacttcactgatgctcattattgtttttaacttcctatttttgatagtttctattgctatgtacccaagacccctaccatttcttctgcaatgtctaatgtgtcttccatcccatccagtgcatttgttatttcagactatatagttttcatctctcatttgttttccatttctcaagaatcactgtccttctttgccagaaatctaaagtcttagtccatgatactacattttggccaggactggaaatttctcatcacctttaatgtatgtaatctttgccaaatgaattaaattctctctcaattttcttttaaaaaattgtaattacaaattagctatgtcaaaaaaagattgtttaaaaaataaggtgatccagaaagacagcttagtatattctttgaagcatcttaattagtaaaggctagtatcattaaaattaggaagtgatgcttggagtcattttaggcattgatactttattctatgtgatcagttcattggaagaatgaccctgggctgagggaatgcatataggccatgtagtatgagaaacaaacaagaacaagaaccaaggagagtatttgattatttggatcctagaatcttagactctcatctcagaagcaagattaggataagaacaggacatgggactagatgcccagtccatggcctgagcatcagtggtaaaacaggagaaaactacaaggaccaggtggatgctgtcagcttgccactgtactactggacatggtaccagatttttctgtgtgaaaacctggctcagcagtagatggggctgagctttcagtgtggagataactgtgtctacaatcaagagagtctgagaaagacagggattaaaaatattatttcttgctttatctatctatcttattcatttacatgaatgtccttcactattgtaatgatcttaaaaacaatgaaaccccaaagagtttacttcagcggaggcagagatgtgaataaattatggaagcttagggaccctcatatcccccatctcaaaaaaatgatactgcagctatgactgcaaaccaaatgcgattgcctttctttgtgttcacatgatgcctgaaatttactagatatgtttcttctctcatgcagcctaacatatatgacttgtaaaccagcccatgatatgtcttagttaggtaaggctgccataccatagactgagtggcttaaacaacagaaatttctcacagttcctgaagctgaaagtccgagatcaaggtttggcaggtgtggtttctccagtggtctttttccttggcttgtagtcagctgcttctctctgagtcctctcatagcaattctctatccacataccctcccgtgtctcttcctcttaaaaacaccagacctatcatataagggacctcttcttaggatctcattaactttcattacctccttaaaggtcctgtctccaaaaacagtcacattgcggggttagggcttcaacttgtgaattttggcaagggttgtgggggggcacaatttcataacatagtatgaggaataggtgtttacacagaatttgtctcctgaacaaaacttctatatccttatattgcagaagccaacactctggctcagaggtttatggaaagaacatttgctagaaggagaagggccagtatcttcactggtattttggacaagggtcttgtttggatatttgttatgtgtgtgtcttcaaagtgtgagaccttcggccacatccctcagtggctgaagtagcattctggattaaggaatttttaaaattaaattaaagttttaaattaacacatgataatagtacatatttacagggtacataatgatgtttcgatactatgcaatgtgtagtgatcagaccaggataattagcatagccatcataattcatattttttactgattggttggccaacatctctccaattcatgaatctagaggaacgtggtttatggacctctgctcctgtggactctgttcaagtccgtaaatggtttgagcaaggattgctcaatttctgttaacctcaccatagtcagggtttggggacctgtaactgccttggagtgatttcaagatgctgggccatttccagtcatctcttattctcacagaaacctcctggcatgcctggcacatcttcactcaataaaaccatttaaataaatgattgagcaaagaacacctattcaagtgtccatgccagaggggaagatgtaggagcatactagaagttaatgagccaggaatttaaagttttaatgtgtttgtccctgaagtttgcctcatccatgcttatttttagaaagccatagattctgttgctggcactcatttctagtgctttttttattgctgatcagttttaaaaagtaaaagcaagttcatgccaactatatatttcagccattttctgcatcctttgcctgcctccaaagcagaggtatacaggggagtggagaataaagccactggacagccgagggccatgtagtcccagagacagctcttccaggagcatggaagaaaatattaactctttccacttgtactgagatatttttagagtggcttcttttctctttggcttgtgccagggtgctactttattgaggagctgtcaaactttttaaaaaagaattatttctatacaagaagagtttccttgattctatatccattgtgctcttttataaaaatctcacttgttctgggaacttactaattaatagttacattgcaagtttttttttcttttgcctcaattacctaaaataagggtaaatgagtgctaagtttttttgttttgttgtttgtttggtgggtttttccttcttggtttttttttttttttttttaaagaaaaaaaagaattactggaaattacatttcaggggcacatgcctagtttgggacagattgaaataagaagacatccaaaacaggggttatagagcacacaacatgtatttccaagtaaaaaagcaaggctgtttttagatcttttgtcatattgagtcattgtaaagaatgagactaaatttattggccacataggataatctgtcttattccttcaaagaaactgctcaggtacatgacatttctgtctccaaaccaaatgtctaatgtgcttttatcttggcaatgtcacttaaatccccttccaaatcttttcttatatgtcatcatgtaaaatagactcctggaaaccaaaatggctactcaggaaggccacgctctaggcagttcatcacaggaagctggagctctgtgcttctggtcctatgctccctgagctgctatagctatggaccatggctaccacccaagggtttcccccaaaccatacctagcctctgcggtctgcctgaggtaggaatttcttagtgtgcattgattctctttcttccactttcctgatgacatttcattacagcaaagaaaatttttggccataaagattttccatatatggatcttttccaaaatctgtgtctgtagttaggaacaacttaataagaaggctcagtgttggcaccatttttaagaatatttatttccctgggctaatattcttttaaaaatactgcttcttaagggaaatgatacctgtaaaagaaaaattagaagcttctgaataaatttgaagaggaaagtcatgaaaaattataattatataaactttacactattattgctcttttgctatattttccggtcatttttgctatatttacctgatttttatagtcatgattacataatatgtttttctctctatttgtttaacattgtattataatcaggtttataatcaggttaacagatgcttcataaacatcacctttgacaactgcatgaaattccactgtatgactccaaatgtaatttactgaactgttctattaatggaaatttatgcaattttaatatttctattcatatagatatatggcaatacagatatttgaacaacattttttttctgatttaggatgttttctttagacagattccatgtggaaatatgaggtcaaaaattagaaatatttttaaacctttgataaatagcgttttccatactgtttcctacctcgttgtaagtacaagtttgtccacctggcttcctaagttggtcaacataaatttgcaccaacttaacatctgaaatataataatatacactgaggttcttagcataatttgtgtttcttttaaattggcattgctgatgacattaaccagtgtgactggggaatgattctgttgtccactgatccatttaatgtctcagttctggccatctagtggtctagtctgtgttttctactgaacaacatattgagcttttctctgctgcttcctggctttcatatttactgcagagaaatctcattgtctgcaatgattggacttttagaatagaatcttagtcatctgtattctacggcatgaaaactaggcccacactatttactactgacctgaggactcagctctgcctgcatgtagacctggaaaaacaccttctgcctgtgctcagaatacctgctggacctggtcactctctacccatgctcttttcctcaatgctttccttcctttcacctgttgtcttttcatcttctctctttttattcttggtctggcactcgtgcaagtagaagtgatttgatagcttcctcaggcttttcataaaaagggaccatttccatgcaagtgctatttttaccagtctcagaattgtgtaaaaggctttggttctgtgatattttctggaccacactataaaaattccctgatgctatagacccatgggttttactttaactcagtatttcctaaactgtgcttctgtggaatttcagttcaatttcaatgggagccaggaactaaggttcccatggtcaaataaactgcaaactgtgcttcctaaatggtcttcttgaagatttgcagttcatgttatcatatctaatggtttggagacatcagaaggaaaaaaaaattatgttttaacttggtcactccccactgaggaactattttttttctctttttattttttatggctatacctagagtcatttttccttaaaacccatctggaaaaagctggtttgaccatgcaacctgtttattaaagtggaccatggttttacatcaaggggaagatgtgacaaaaaataaacattttccagttttggagctggactgtgcacacatttctgttcagcagtattagaaccccttcaacatttggaaattataatgtttctgcagatgggaacaagctggatgccaaggagtgtgcatgagcgagagcagaggcccagcctgtgagctccactctgctctgctggcagtgatccagtgactacctaacagagagaagtggatagctttatgggcaattgtttgcccactggttgaaatgcttgggttggatttatcggaaccatggtcacataaagttgtctgtcacccaaagggaatcataaagatgccttgagtaccagagaaggatcattgatttctttggagccatagtgttcagcctctcacagctggggaactgctttgctgtgaaatagaatttcagttggatacaaaattaatcagttttcacagttcaaaattttgactaagacactgtgtcagtgtgtttggtacatgctgtgtttgagcctggaagcctacgcctcacatttgtgtagcatcgtgacaccaccaactgcctgttgatgtcatggggaaccagggtaatggggagcggacagtttctcctctgccactctagctctttctcccagcttgaatacagggctgacctttcacaaactaacacatctagaagggaccttagtgactattaatccaacactgaccaggggaagaaatccttttgcaacacccatgatcagccgctgacccaacctgtgcttgcatacttgtaataatgggggatccaccaccctacatggcagccctatggttagattttgaatgataactaggctttggtgaaattcctgtttcgtgaataaatcaaaaagaaggcaaattccatgttgtctcatctctctactggcatgagatcaatatcaaggagacaatcaatcacttatctttcatgtctctgatgtgatccatttgctatattttggtctcaaatgcttgggaagacagtagatagagaaagaaactgatacttatgatccaaaatgatctgccaaatccaatctcttgaggcaattaaattagaaggatatataggtcttcccaagaaacagaactaggcaaacataggcatttatatttggtgcaatatcctcaccctaacaaaaaaagaatgtttttctacttatatagctgatcacacagaaaggatcaacaatcgagtttttgaacataatttttcatttctcaaaaccctacttgcataaggaaaacagtctgttcacaaagagggtttcagttttgcagtgaagtgtaatgggaagaatatattcagatatgtttattaatcaagatctacccctgtctttttattctatattcgtttaggtggtccgtaacaatggggaagaaaagatgagcaagttatggcccttgtccttaaggagctcaggatctccccagtgggctgcaggaatggcaaatacccacaaaatagccgccacacaaggcagagagtgatacgtgttctactaagaatagcagtaaaatgctgaggaatcagagagatcaaggttaatgccaggtggaagactggggaaaagtacacagctgaattgactctgagttgcatgtgggaaaatggatgagatttcaaaaggcagagattaaagagttactgctacatggaggcattttcctagaatgtccctcagtataggaggcaggggctttcaaaactctgtattcatcattttctatagacatttttccttgtagtatgtcttgtcactgtatccatagctaaagttttggagatttgtatgcttatatcattgatgggattgttttaaataaatgtcttataatttagcaattttagttcctggagtcttttcacacttactgagaaatctacaaggtactcttcttggttcataggtaggtacccattgcattgacttttaattttgggtggagtctgagtgtccttattctcttttctcatggaaaaatgtcgtgccctggccagggaggaggaaaagaaaaacagcatactgctggatggctccaatctttctgtagtattgaagacagtgggagaaggaaagagagaaaaagggatgggagccgggggcggtgactcacgcctgtaatcccagcactttgggaggctgaggcgggcggatcacgaggtcaggagatggagaccacggtgaaaccccgtctctactaaaataattagctgggcctggtggcgggcgcctgtagtcccagctactcaggaggctgaggcaggagaatggcgtgaacccggaaggcggagcttgcagtgagcccagatggcatggcgtctcaaaaaaaaaaaaaaaaaaagaaaagaaaaagggatgggcctttcaatctggtgagtgcaagcaagagtcttgccatggtcagggatgtgtaaataagggcagctttctctcaatatggacattctcaatggacatttacattcattcattacgttttcctcgaagcatggaaggagtacatgctgtgtatcaggagttgccttttcaaagctcacagtctggtgaagggaaaggaaacatgtaaactggcatttgcaatgcaatatgataagggctatgacaaaaggaatgtggaattctgtgtctttgagggcagataagagagactgcaaataatagctctagaagacaatgtctgagccaagcaagaattaggtgagcaaaaagatgggcacctttttaaaaattatgggcatttagtgagtgattttataaagaaaatagcacattcattcatcttaattaagtttactttgcagttaattacgctgagtgaccttggggatatataagtatttgatacagacttaatatgaggtggatgcaaatatcactgataggtgagtgtgtgctgcaaaacgatacagagtccatctgtgtttgagtaatgataattatcaaatctcattggaagtttttcagttattgaatggaataatatgcagttcttctcttaataaaattaattcaagcatactttatattaaacaatatattttggaagaacactaccaacaaatttaccaaaacaaaaaaaataatgtcacagctctcaggaggtgccagcatttattgattacacactacatgttgttacatacattcatttatataattctcattttaaaaaatcttagctgatattgttggctactgcttacatttcatcctccgtggcctttacttcaactgaatttcagttttatgccaacaatcagcccactgtccttcacatggccgtgcatttgcttcatgaagctactcaggggaatgccaatattcagactgagaatgcttaagaggtgggcatgggactcaaatcttgttaatgaattaggagtgatgatgtttagatgtgatgcctaaaatcatggcagctatctgtgacaagggagcctagcctaaggatataaccaatgatggctcagcaggatatagccaatgatggctcagcagaatgagtcctttattttgggggatctaggtaagcaactatattagacaacctaggaaccctttcctactaaacgaggtaatgttattttccttcagatttaagccatttgtgttgagttttctgaactctcagccaaaatcattctcattgacaggtaggtactctcattatctccattttacaaatagggaaattgggggttcaataagttaagtcagcacttttggaggctatggcaggggatcacttgagcccagaagtttaaggcagcattgagccatgatcatcatgccactgtacttcatcctgggcaacaaagcaagaccctgcttctcaaacacaaagaaaaacaaacaaaaaaaagaagttaagaacttaatgaacatcatgcagctggtaaaaatatcagaattaggatcaaaatcaagtctgtcttacatcaataccctagtggttaatttgtggttagacatcttctacatatattttttgaaacatatcacactaaagcactgaaataaataatgacaaaaatgtctagtaattcaaatatataatctgtgagaaagccactttccccagtaatgttttatatcaagtgttggtaaattgtgtaaggggtcaaataataaatattttagagtttatgggtcagatggtttctttcacaactactcaactcattgcagctcaaaaagccatagacaatgcataaacagatgagctcagcactgtttcagcaaaattgtaattacaaaaacatgtggcagaccagatttgggcctgggaccatagtatactgaacacttctctacatgaactaaatctgattctttgtgaagggttcgccagggaggatgggcaaaagctcattttactaggtgtgtaccaaaaaaaaaagtcacaccagtagaagagaaaaggagatatggagtgcagtgtggaagggacagagagtgcaccctcttcacaaactttaagatatcaaagaaaatgactgttttcctactttgtagtgcagattgggaaacagcttcagacaacacaaaaggaggggagctcatggcttccaccatcagagaggcaaagttagatagtagatttctagcctactatctgtgcttaaattggaatttctgttaaaaattccgaattttctcagcaataactttcaaagaccaccacaccattatctttctttctttcttttcttttcttttttttttttttttacagtcttgttctgttgcccaggctggaatgcagtggtgcagtcttgggtcactgcaacttctgcctccctggttcaagcgattctcctgcctcagcctcccaagtagctgggattacaggtgcccaccaccacatctggctaatttttgtatctttactggagatggggttttgccatgttggccaggctaaagacaaccgttatctttcatactcaaaatattgaatgacccacaagcagtataatacatagctgttatttctgcaaatggagagataagaattggaagtgaacagatggttatagctctttgatttttgttttaattgctttccaacaatcacagagaatggaccaattttctcaataatatttgttctgaaacaaaggtctgggagtcaagtttgtcaataaggcaaagagtttttgggaggtatgtgagggtttttctttttttttctcaaatggtttgcaaaggcataacatgaaattgactgttatttatttgcagaatcttaactactgagccatatttgtccccttttacttcttactaaactggaaacataaaaaagggtttataggaaaccaaggttaacagataggaacataaagtttcactcttctttcctgcttctggcaaccactaatttattttctgtctctgtggatttgcctattctggacatttcctataaatggaattatgtaatatgcagacttatgcctactgtctttcactgagcataatgctttcaaggttcacccatgctgtagcatgcatcagtaaataatgtcttttattagtgaataatattccattggatagatgtaccaacttttttgtttattcatcacttggtggacaatggagttgcttccactttttggctactatgtgtaatatttctataaacactcataaacaagtatgaacatttgctttcaattctcttatgtgaggagtggaattgcttggtcatatggtaactctaacatcttgaggaatgatcaaacttttctgcagaagctgcaccattttactttccccagcattgtatgactattcctatttctccacattcctgccaatactcattgttgtccgttctaatgggtgtgaagtgatatttcattgtagttttgattttactttacataaacactaacaattttggacatctttttatgtgtttgttggatgtatgtatatattctttggaaaaatatctattcaaatagaaaggaaaattttaaagaagagaagatgtatgataaaatttatattgactgcatgtctataatgcattggggtctttactcataaaaatgaataataagtaatattttaatcatattacataaataagattcagataaattaagaacttgctaaagaaaatagttggctatggttaagccaagagtcaaataagatccgcacgccttccctttgtcccatgtacatatgcttcatgtgcatcgatatgaagatgtacatcttacagagatgaataagacaaacatgactgaataaagcatgagtgtgcccctctcctctctggaaaaaagtaaaaacataaaaaacttttatggaataatgcagaaaaggatcaattctctttctgatgtcaatatgatagtaaagttgtaggtagtgcacttgtgagatcatcaccttactagtgattgatgggggcatcccactctttattgatctagtctatgtaatagcacatgagaaatccatgaaccgccctgtggagggcttatttatcttttaaaatgctataaccacatccagtatctctaaacaagtgcttagaagttagaaaacattatgagtatattagccacctagacaccactctcccctgcccagcacttagcagagtgtagattgggtacatgacagtcacgcatgccttgttgctcctgggaggcagacttgccttattatctgaactgatttcctcactttccaccccaggaatcaatacagtactcagcagtcttatattagatgctccatgatagattgttaaataaatgactttaattggcatcatacagcgatattacagaattagatatacagttgatgctcaataaatatgtgctgacttatttagtaaagaaaggaaagatgtgcttggtgccaagcactgtgaaaatcccactaccacacattgtcttcttttctcatttaggcttcgtgaaaccccatgaattatatgctttcatatattcaccttattcatgttcaaaatgccagcaagtagtaaagtagtaatgcaaacccagatctgcaaaagtacattacaaagcattaagttggatatttagaactcggcacactaaatttcatctggggctaaaacacagagtcccaatgtagtaccaagaaacaagcctttcccacttttgcttaagatgacaccaacactgccatgaagaagatgaacaggggtgcacaggatgatacttcttcaaataagtgaaatgattgatgtattgggtactttatgcaagaagatttggagaacaatgtaattgttttataatctgattgcgtatccctaagacctggatgttttcaaaatgataaatgacttaatgactgaatacattctagttgcctgttttaaacaaatgtgacattttaggggttaatgctacattcttgatttcctgtatttttagtcagtaactgtattagtctgttctcacacagttatgaagaaatacctgagactgggtaatttaagaagaaaagaggtttaattgactcatagttccacatagctggggagtcctcaggaaacttacaatcacggcggaaggcacctcttcacagggcagcaggggagagaatgagggccagcagaagaaacgccagaggcttataaaaccatcagatcttgtgagaactcactcactatcacgagaacagcatgggggaggctgcctccatgatttggttacctcccaccaggtcctttccacacacggagattatggggattacgattcaagatgagatttgggtggggatacagccaaaccacttcagtaactttctctctgtttaaaaatttttaaatttctattttttttaaagtttgaacatgttgaggttcaaatgtcttaagcttccaagtgctcttttgacttttaatatatttctggagtccctttttgtcttcttggtccttaacactttggttgcatgcctgcatttcctctcctgcttgtgtgcacttctcatctgccatgtctaggaagttgtatcctttccacttgatttagcatttctttatcttctgtcgtgcagctatcaatatgccatctagggtgggggctggagatataagacagcttaaagatatcatccttttacttaaacaactatccatcttttaaagtactttaatataattttcataacttttccggtcagccagagtgaatactctcgaaagtgtctttgacagttggctttattttttgaggaggaaacttctcttgattgactttgtttgcaccgtgatttgcagacaagatactaagaatatgggggtggtggttggggctagtgttagagttagtcctgttataatctcagtttctcaacccatccaaatgagaacaccatagaagtaaaaacatatttcctatgcaaaggctgcattaagatatgtctagttcccacctcaacccactctctaagtctttcttgcataaaatgcggagccaccacaccactactgacaaaagtgccctctccacgaactctcctagaatattttttctacttctgccatgacacttgacatagttagccaatgcataagcagggcttcaagccaggctcttgtgttgcaatatctatcctttctttataccccaggtggagaagaaagtgcttggatatctgaacactagaataaatgattcaaataagagctaaaactattaaggggaaaaataagatttttaagtaattaaagtgagtgatattcattttcatgaaggaatctgaagaatcaagtcaatgtttagacattaattcaaagccatgatggaatgaaaagaaaatgtgacagagaaagtaatagaaattccctgagtcaagcactgtctttatttttgcactcacctacctccccccaatatctactttgcacagtattttagtgtgtgctcaaaaaaatgggtgttgggtgcttgctttggcagcacatatactaaaatgggaacaatacagagaaagttgtcatggccgtgcacaaggatgacatgcaaatttgtgaaacgttccctatttttatggttaatgggtacaaaaaaaaattagaaaatgtaagacctattttttgatagcacaacagggtgactatagtcaataataattgtacactttaaataactaagagtgtaataggattgtttgtaacacaaagtataaatgcttgaggagatggataccccattttccatgttgtgattattatgcattgcatacctgtatcaaagcatctcatgtaccccatgaatatatacaccagctatgtatgcccaaaatttaaaaataaaaaatatttttaacattggtgttgggtagatgggttccaagatgaatgaactactaaaaaacgatgccttctaattgctcttatttacttattctggagtgataaatagagtgtttggcaaggagaagcttgcatatgtgtagcttaaaagagtccaaaactcagcacggttggaaatgcagaatattaaagagatttctttatggagttgggcttttttgacttttccttgcctttctatggatgaggtgtgaaataataagactgttgtgtggtccctccatagttcagtttcatttctgtaaaatgaaaatgatatttatattggattaataggtttattccaagcattattactgcatgctgacttctaaagtttctcttatcccaaggttgttggtttgaattgttaaaactataagtcctaagaacagatttatttattttatatgtatatatctgttttatttttatagatttagggagtacaagtacagatttcttacattaatattttacatagcgttagagtctgggcttttagtgtactcatcacccaaaaagtgatttggtaacccaataggtagtttttcaaccctttccttcctcccaccttcccatcttttgtagtctccagtgtatattatttaccactaaatgtccatgtgtaccctttgtttagctcctggttataagtgagaatataaagtattttactctgtttctgagtttactctgtttctgagttattttacttaggatcgttgcctccagttcctgttctattgatctgtatctatttttataccagcaccatggtgttttggttactaagccttgagagtcctagatttcataaaatggtatgatttcttttttatggctgagtagtactttatggtatttatggtatatggtatttctggtgtgtgtatgtatatatatcatactatatgatatatatatatggaatatggtatttatgttatatatatgcacacacacacactcattaatcatccattaatgaatacttaaggtgattctatatctttgctattgtgaatagtgctgccaaaaatatgcaagtacagatatctttttgatataataatgatttctttcccattgggtatatactcagaagtgggattactggatcaaatggtagttctatttttagttcttggataaatctccatactgttttccataaaggttgtagcaatttacactgccatcaacaacgtattagcattcccttttctccacatcctcacaatatctgttgttttttgactttttaatattaaccattctggctggtgtaagatggtatctcactgtggttttaatttgcatttatctgatgattaatgatgttgagaatgtttttaatatgtttattggttgcttgtatgttttcttttaaaaagtgtgtgtttatgtgttttgccccctttttaatagagttatttatttttcttgttgagctgtttgagttccttgtagattccggatattagccctttgtcagatgcatagattgcaaatattttcccattctgtaggctgtctgtttactgtatttatcatttattttgctttgtagaagctttttagtttaattaactctcacttatatatttttgtttttatgatgtttgtttttgaggacttggtcataaattctttgcctaggccagtgttcagtaaagtttttcctaggttttcttcaaggatttttacagtttcaagttttacatttcagtctttaatttcatcttgagttaatttttgtatatggtaagagatatgggtatggtttcatccgtctgcatatggttatccaatttttccagaaccatttattgaatagagtgtcctctccccagtgtatatttttgttgacttagtcaaaggtcagttcatcataggtatgtggctttatcaaatctagggctctcaatgctgtagtaaccaaaacagtatggtactggaataaaaaaatagacatatagataaatggtacagaatggagaactgataaatgatttcagtaaagtttcaggatacaaaatcaacaaggaaaaatctgtggccttgctaaacaccaataataataatcaagctgagaaccaaaacaagaactcaatcctatttacaatcgttacaaaaaaatacataggcatacatttaatgaaggaagtgaaagatctctacaagcaaaactacaaaacactaatcatagatgacacaaacaaatggaaaatcaccccatgctcatggatttgaagaatcaatatcattaaaatgactgtactgcccaaagcaatgtacatattcaacaccatttgattacattaccaatgtcatttttcacaggattagaaaaaaaatcctaaaattcatgtggaaccaaaaaagggctttaatagccaaagcaatcctaaacaaccagaacaaagctggaggcatcgcatatctgtcttcacattatactaaagacagatttataccatgagagtagacctgatgtacagcagtgcacttcactaattgtattgactgttaagaaattacaataattttattctatatggtaactaaccactgctcaaatcccccctgaaaattgtccccccaatgccaccctggatgcctgggttcccaaatctcctcagtgttaatccagaaacaagagttaacatttagccccagagggacctccaggacgctgcttctctcttatgaccgtacagatttattctgattagtcctgtaatttccatatgacttattaaatattttgaacatcacatccatacatactttccagacaagaaatttggatgtgggagaacattctttaataaagaaacacataaattctcatttaaaaaaactgctttttttttctttcttttttttttattatactttaagttttagggtacatgtgcacattgtgcaggttagttacatacgtatacatgtgccatgctggtgtgctgcacccactaactcgtcatgtagcattaggtatatctcccaatgctatccctccccgctccccacaccccacaacagtccccagagtatgatattccccttcctgtgtccacgtgatctcattgttcaattcccacctatgagtgagaatatgcggtgtttggttttttgttcttgcgatagtttactgagaatgatgatttccactttcatccatgtccctacaaaggacatgaactcatcattttttacggctacatagtattccatggtgtatatgtgccacattttcttaatccagtgtatcattgttggacatttgggttggttccaagtctttgctattgtgaataatgccgcaataaacatacgtatgcatgtgtctttatagcagcatgatttgtagtcctttgggtatatacccagtaatgggatggctaggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttcatgtgttttttggctgcataaatgtcttcttttgagaagtgtccgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtaatgcctaggttttcttctagggtttttatggttttaggtctaacgtttaagtctttaatccatcttgaattcatttttgtataaggtgtaaggaagggatccagtttcagctttctacatatggctagctagttttccaaacaccatttattaaatagggaatcctttctccattgcttgtttttgtcaggtttgtcaaagatcagatagttgtagatatgtgacattatttctgagggctctgttctgttccattgatctatatctctgttttggtaccagtaccatgctgttttggttactatagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttatccttgaagaggtccttcacatcccttgtaagttggattcctaggtattttattctctttgaagcaattgtgaatgggagttcactcatgatttggctctctgtttatctgttgttggtgtataagaatgcttgtgatttttgtacattgattttgtatcctgagactttgctgaagttgcttatcagcttaagcagattttgggctgagacaatgcggttttctagatatacaatcatgtcatctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatatctaatttattgagagtttttagcatgaagggttgttgaattttgtcaaaggctttttctgcatctattgagataatcatgtggtttttgtctttggctctgtttatatgctcgattatatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgagtctctgcccagctttggtatcagaatgatgctggcctcataaaacgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaatttcttcctggtttagtcttgggagagtgtatgtgtcaaggaatttatccatttcttctagattttctagtttatttgtgtagaggtgtttgtagtattctgtgatggtagtttgtatttctgtgggatcggtggtgatatcccctttatcattttttattgcgtctatttgattcttctctctttttttctttattagtcttgctagctgtctatcaattttgttgatcctttcaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatacatcccagagattctggtatgttgtgtctttgttctcgttggtttcaaagaacatctttatttctgccttcatttcgttatgtacccagtagtcattcaggagcaggttgttcagtttccatgaagttgagtggttttgagtgacattcttaatcctgagttctagtttgattgcactgtggtctgagagacagtttgttataatctctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattggtctgtctaatgttgacagtggggtgttaaagtctcccattattattgtgtgggagtctaagtctctttgtaggtcactcaggacttgctttatgaatctgaatgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttcccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacattttggcatgattttgcagcagctggtacctgttgttcttttccatgtttagcgcttccttcaacagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacctgacctttctctctggctgctcttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggctccattctccccatcactttcaggtacaccaatcagacgtagatttggtcttttcacatagtcccatatttcttggaggctttgctcatttctttttattcttttttctctaaacttcccatctcacttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcttctaaagccttctctcagctcgtcaaagtcattctccatccagctttgtttcgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacgggaccctcagctgcaggtctgttggaataccctgccttgtgagatgtcagtgtgcccctgctggggggtgcctcccagttaggctgctcgggggtcaggggtcagggacccacttgaggaggcagtctgcccgttctcagatctccagctgcgtactgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcccggctgctttgtttacctaagcaagcctgggcaatggcgggcgcccctcccccaacctcgctgccgccttgcagtttgatctcagactgctgtgctagcaatcagggagactccgtgggcgtaggaccctccgagccaggtgcgggatagaatctcttggtgtgccgttttttaagccagtcggaaaagcgcagtattcgggtgggagtgacccgattttccaggtgtgtctgtcacccctttctttgactcagaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcggaaatcaccgtcttctgcgtcgctcacgctgggagctgtagaccagggctgttcctattcggccatcttggctcctcaaaaaaactgcttttttacacggaacccacgaacatgaaaaaataaaaaaaccttgattattagcctcaggtatgttcacaaaagtatagatatgtttttcatcattcatttccaaaaacattatcagagatttggagcaaaaaggtgctgttaccttatcattctgaagttttgtgtatgcctatgatgttggtataattttcattgttacaaccattatgatacttattcacagaaagcgtgcattaagcacttattgtgtgtcaggctttgtaataaattatggtgatacagagactgacttgctaggtccctaagatcccataatctagtttgagaagagtatggagaaggaacatgtaagcagttaaactgcaattcagagtgatcatcacagtattagagatgaacaggaagtgtgcctggagctctgaatactttcagccacttctaacctgaggagctagggaaaacttcagtatgtgcttacatttcacataaatctgaaacaattagaaattatttgttagagacatacatgtagctgtgtatgaggtaaagggaatagcacatttaaattcatagagtctaaaagtcgccatatgtgttccagtattattggagctcaagaaatgtgggaaagagactaggaagtgcagtcccagggagccttctctgatggcttgtgtggggaattgctgaataagctagaaagggtttatcaatctcgtgtaatgaagactcaatggagttttagccacaatatggagagctcacatgtgctattgaggtggttgtgttaactcttcttttttttttttttagatggagtcttgtgctgtcacccaggctggagtgctgtggcgcgatctcggctcactgcaagctccgcctcctgggttcacgccattctcctgcctcagcctcccaagtagctgggactacaggcgcccgccaccatgcctggctaatttttttgtgtatttttggtagaaacggggtttcaccgtgttagccaggatggtcttgatctcctgacctcgagatctgcccgcctcggcctcccaaagtgctgggattacaggcgtgagccactcgcacccggccgtgttaactcttagtaagtagtagaagccagtgtgaggtacagggagaccagacaggaggctgtttctatgtgtgagaaacttttatccactagaagttcatataaagacacatttgggaaataaagttgttgtagagaaagatacaccatccccaccgtggatagcatccagattaatgctggaaatcacatttcaattagaaaattgcttaggaaacatgatgtcagaagaaggagagccatgtaattcaagtctttggtggcatctctttcaagtttcccagtgcacctgactcagaagatagaatcagtctgttagctgaggtctctctgtgctggagaagcatgaaaagggccccaccagcatagactcagttctctttgaagtttaagatccatctacaaatggccatgttctttccttagcagaaggtattggggtttctacatacatgctactcactgctcacgtgtaagtaaggtaaaatttgagcaagtggaaaatgaccctgctgtaatccagatcataatatttctaaataagcacacacaatagtcaaccaacctacttcatgatcttttatggaacaaggcagagacaaggccactctgcacccacaaaaatgtataagtatgcacttctgacctatgtgaggtaagtgtctgctacttctctgtcaatggcaagccctactaccgtcctccagcatattggatttgtaggccactcagttagcaattgtcttcacttctacatagcattcaatccttaatgtactcctgcttttcttagcctatagagtagttcaaactcccagggaggctgttttgttagaaggaatgaagtcactatggatatattgaaaatctcatctacaatagttaaaagtccataatttagggttagtgtgaggatattcattcaataagtatttactgaataactattggatagcaggtgatgagttagttattaggaatacatatacccacatacatgcacaaacacacacacacatacagacacatacacagatatataacatgtttgtatcttccagaagcatacggtttatgggataaacaaagggagataatgaaggttattatttctagtagcaagtttgagaatatcccatagggtgaggctcatttttgttagactttgataaatcatctcaaaggctaggcctcccagacgtgtgtgttatctgtggctcaagactatgagtagcagtcatagctatgattgaaagaatgagagacaaagagcagaaagagtggggagtagttctgtgacctaaatggtgaaaaggccccagagaagaaagcctttactgggcaacactatagagagttttgtagagaacagaaatatccaatgggaatttattttttgctaaagttttctctgtcttataatatgttatctggatgaaatctgtggacaactgtgggattgtgggggtgcaaggtggcaacctgcagagcaaagcatgtgcaaaggcctgaggggacatgggaaatttaaacaattgtggcttgtgtattgaaagtggggggcagttattatgtatgagatgaggagtgagagacacagagggcttgggaagattttggtcttcatcgtaagagccgagataagccatgacatgattttttgaacagcagtgactgattgctatgtggtttttttttttttttgcatatattatggaaacagattttattgtaaataattcattttagggtgggtagcatgtgcacagacaggtctgtaaggaatattccaggtaagatgagatggaaagaagtggtaaattcaaaagatatttaggagttagaatcaagagtatttggtgattgcgcatgcaggatcaagagaatggctactaggtttctggcctggacaatgggatcagtggtgtcacattaactgagactgggagtgctaaagtgcaagtttcttgaggaagagcaagaattccattttctataagcaaattctgagctgcttttgggatgtccatcaagaggggaaagataagcacagtgtgctgcattgtgccagcaacatagaaacctccgtaagtaatattcaggttcaactcagtagttaatattcaggttcaactcagtagttaaggaagaaaccagtcatcgtttcaattcattaataaattaactttcattgcaaaatctgtggggatttctgtcttccaacccaacattttcttcccattttgcctttaatgaattcaccaccaccacctctcactgtgcatttaattactctactgattacttactatgtatgctacgtgatgtggaaagaatagaaaacttaaaagcaaagcactctccctgacctccctggggatagagaccgaaacgtataaaaaaaataagaaaacacattaaactacatgtaacaagtgccagatgagtgatccagataattgcacagtccctgtggcccctagtgatggggtactatttctaatgccagcagcagtgcttccttaaactgatccctagaccttggtcatggtgcttggaaaaccctttcttagcaccatctctgctcatcttaatcctaacactcctttattcttcctgtccctctttttttggaaaatcctttccaattgttttgctttgttttcttctcgtttgtcctctatgctgctgggctgatttttccctcctttaatgaaattccatgctctttctctaagttgttttggagcccttcttatatcctaacttacttcgcttcccagaaatttttaaaatagagtttttgttcactataacactttttttttttttttttttttttcctgttttgagacagggcctcactcagccctgtctcaaacaggctggggtgcagtggcgcaataccagctcactgcaacctcgacctcctgggctcaggtgatcctcccacctcagccttctgagtagctggggtcacaggcgtgcgccaccatgcccaaataatttattattattattatttgtatagatgggggtctccctatgttgtcgaggctggtcacagactcctgggttcaagtgatcctcccaccttggctcctgtagttctgagatacaggtgtgagccagagtgcctggcctgtgataccactttttaacacaaacaattagaaaaatgctgtataaaaaagttgtccttttttttttttttgacagagtttcgctcttgttacccaggctagagtgcaatggcgcaatctcagcccgctgcaacctccacctcatgggttcaagtgattctcctgcctcagccttccaagtaactgtgaatacaggtgcctgccaccatgcctggctaattttttgtatttttagtagagacagggtttcaccatgttggccaggctggtctccaactcctgatctcaggtgatccacccatcttggcctcccaaattgctatgattatggatgtgagccaccgcgctgggccaaaatttctcccttctgtaaattcctattccgtgcctctgtgtcatgccatccataagcccaaggattaaagatgtgaagacctgctctgctcagtggaagcaagctcatggtccagtcagacagtcagatgggagcttcagaagctgatggatgtggagagaatgatgtctgatagcagggcccactctgaaataagggaacttaaagaaagccttgaaatacaaattggtattcacgggaacataaggcccctcctgtttacttacaggaaccttcatccatataattgttttgaaggcaatagctctataacaaattatttaccaaattacattcctagaaacagaagtttgattaagtacatgccaaaatagtaccatatagcatagccagcttagtgtattggactgtcttaaaagtggcatagctttaaaaaatataaacaagcttccaaaagtgttgaatttgctcacagatgagagtttttgattactaagatacaccaaggttgtttaggatcataacttttatagtttggcattagatcttatccatgttctcattctcacaaatgttccgtgtttcttcttcagaataaaacactcagctggatacattagagcacactgtgccaccttagggcacagaaagaaaataaagaattgcaccttacattttatttttggctcattcttatttatgttctattttatgtgttttgtagtgtatcttgtatgttgaaaattaaacaaatagatgtatgaatacatacatgaactttaatcagatgtacaaatgtaggaggatatcatccaaaattattagcatctctttagtaggctttgtttggttgtaagtgatagaaaacctcagtaagagtgacttggacacagtatgcttattatttagtcaagaaaaatctaagtaggtggtcttagagttagcgtagcaacctcgtgagtttattaagggtccagaatttgcctatatttccatacacatattttgcatgatgactttcaagaataaaatttcacctcatgatgaattacacttaccttagccaatgcctctgtgatttcaggtgggtaatactatgtagataatatatagtaaaatgcataggtatattctaaggtttcaaatgtattgataattgcagttatttacttagagaatgatcatacccaatattttattattgtttattatattgtcattaaaaagttataataatgttgttttctttgaattcagtaaagtcattgtgaaggttaagcatgtgcattttaaattaatttggagattctttaagctatggaaatggaaagcctcagtacatgttaagcctgatatctgagctttcccaccccagacttttgcagagccattgacttgggtctctgatcctctgtaatgtgctgatagatgataacatgatggagaaatcagttggtagaatggggcggtaaccactagagatagcagttgtcagatggaaattaattgattgtaattgctttgccattgtattgcacttgaagtctgtagcttgttaaaaccactgattataaaataaggatctcactttttatgctgtagattatgttaatgaaagctgttcttagaagcatgatcagtgaatatcaataaatggataataagaaattaaaggaaaagttaactaactgatcatgagttaatatacttcagcagccagagtagcagtcaactgtgcaccgtttcatattgaattttttgctcagagctcttgaattttaaatatttcccatagagagattgattctgtgtgactgtttatcacgtactgtcttgaataacagatcttttctgtagagaatctcctgcaagatggaaaatgtgtgtgttttgcagagcctttattttgtgccaaagtattaacaagcagatattttgaaatggaaaacataagttcccattgcaataccaatagtggtttatttcagtgctcgtggaatatgagtaacatatgtgtgagggtctgtgtgaatctgaaggccttgctgttgcaatctttatcaatattataaaaagtatactaaaatgataacataaatgttaaattatacttcactttttgctgtacaaaatgcgttaacttttataaaattataatgaggtttttaattatagctttcatttatagcatttaattgttgatgttagagagatcagagattttggagatatttttctgaacaccagttctcattaagcctccatgcaggccctcaaggaccttacagaagaaaggaacagataaaacaaagaaaggattacttgcagtgttgaatgcagtgatgaaagtgataagaggcactgggaggcacaagatgagatcatctaagttctgaggatttctgggtgtcttcaacaaagaatgaaggtctgggaagaaggagcagtgtgacagttcttggtattttggggaaatagaatgatagttgaaaattaagttgcataaagttttagagtgcaagaagagaccagacagataaacatatagatggcccatgccctggtttgccctactgtggattttaaagttattcccacaggagagcccatgaggatttttagatgtgggagagacaggggtgagtttccttttaaactgctcgctcaccatcagttgtgacgataatcagggaagaagctcattgtgaccttcatttactgtcttagtccattttctattgctttaactgaatacccgaagctaggtaatttataaagaaaatacatttattttttgcagttttggaggctgggaagtctaaggtcaaggggctgcatctgctgagggcattcttgctggcaaggactctgcaagccctgaggcagtgcagggcatcacatggatagggagtaagagcatgtcaactcagtccttctttctcttcttgaacagccaacagttccatcatgggggcctcaccctgatgaccttatccattcctgattacctcccaaagggccccatcttcaaatatcatcaacatatgattttgaggattaattttccaacacatggaatttgggagacacattaaaacaagagcggttaataagctggtataatatcccatgcttgaatattattattaatctaaatctctgtaaaggaaattaaaagcttaagcattgaataattttttcttctttgactttttaagtatattttttgttgaatgttgtggtggaattggagctaatagttgcttaaaactctgtaattggaacaatgtctacatgtggtaatagagtctgtatcttatagatagcacttatttattgttattctcatatttgggatgcagatattgatgtataacttaatttgaaaatgtaagtaattatgattttaagaatgcatgtttaagatatgctaaaaaatggcaataattggtcctgttaaatatttaccagaaacattcttcatatttgagaatctgtttcagaatttagaacatttgcattttaattacataataaaaggagaaagtgaaagaataattggcttagctattagccaattatagctgtaactgaaaaaaaaatcccccaaactgacattggattccacagaacagtcacaatatacattgatcagatgtttaattatatttggcagcaataaagggaagggaatgttgtttcaatccttcatacaacatgtttgttaaaactgaaattaatgagggtggatttggggtgtttgacttaggatcattcagcttttagtgtttacttgtccacaaatggggcttctccagagtgactccaatagataaaatttagtggagaaataagacaattgaatatagtggttacagccagctgcatttggtcagtaccaaggagggttggagctgtctgtctagagtcccagaggtcagagcccatgagaaggcctccatacagagatccagagccagtgacaggagttgttggtgtcagaatgtactgctgacagcgtttccccctgtgctttccctgacagatacgacgacatattccacagagcgatccgagcacttcaaaccctgccgagacaaggaccttgcatactgtctcaatgatggcgagtgctttgtgatcgaaaccctgaccggatcccataaacactgtcggtaagccactgaggccactgatggaaagggcaggcccgttgcaaggcgtgggggtggagggtgctggcagcatctggtatgtgtcatatccgggatacacacagtcccaccgtttgaatagcagaattgcgagtcttaatttggaaagggcaaggctgctgcctctttaacagtggaagaagacaaaatggaaacaaagtagttacggtttaagttttacctgaccaagcaaacaaagatttacttttagatctgcaaagttaatggaaataattatttacacactttagaagcgtctgtttatgatgtggagcttaggcatatatcctagtactcagaaataatctgttcttgagaacctacagactgtggcaggagaagcaaactgctcatctaagatctagaatctcagtgtttattgtgaaccaaccccagagacttgaactgtgtccagagagaactgcattttattttgtttctgccttcctttattaatttcagtactttttcttaacacctctgatgaaacactctccagcaagaagttgtaaatgaaatagtagtcctgttatagtctaggtagagaactacttggggaaaactcccagtagagatcaggaaggtgtttaattggtttttagagacataaggttatgtaactgctaaaaataaaaacaaggggggataaagagtgcacttatagacactgtggctttaagactcaatagaagaatcaaattaacatctgaaaaatatttcttaccaagctttcatttccagtattaccctggtaatttgtttttctttgcaattgtgtatgcatcagtgatcatatatatccacaccccttttcttctctttatttactcttctcgtatgacacagttattaaattaattattctgaatagtgaggcatggaaaattatgacttttttctattactattataaaactctattcccatgttgtttcactaagatggtgtagagaaatgcattgtatagttatgaacttagaacatgccatgccagcagaagctgcctggatccaagagccaggtttagtccacagggaagatgtattgccacactgagcaatggcacaggtttggaagaacagatacgtgatatagtaggagggctctgtaaaagttaccatatgtcctgtgtcaggacaaatagaactgtgacctttcctcacccctgacatgtggtgttcatatatgactttggcagtgccgctgcattcaccctagttacaaaatttgcaccctattcctatgctctgcaaacctgggttggggaagaaggggagtggggattgtttctctccacactcctcctctctcatatttattgtgactgtgcatgtatggatacaaagcacacaagtgacattaagaccttaagggaaaatccaggaatgagctactccttcaaagcgtgatgtgcatgcaagctcttttagatcctcaaccatgttacagtggccaatctaatgggataatcatttggaagtggccaatgcaatcaattatgtttgaattcgtaatcaattgaagaagggatgaatcagaagcattagctaaagtagtggctttctttgatggtgttttaccaagaggaggaatcagatcaggtcccaccacagtatgcaggctgagatgattcatcttttccaaaaactgagactatcaggagaacaaagtaattcttctttttctgcatatggctatgctgtattcttcattacttcatgagtgtatgaatttgctaggactgctgttacaaagtgctacagactgggtggcttcactatggaaatttactttctcacagtcccggaggtcagaattccaagatcaaggtgtcagcagagttgattccttttgaggcctccctccttgacttatagatggtcaaggagatgtaccttattatgtttcctctgtaggtgtttgtgttcagagttgattccttttgaggcctccctccttgacttatagatggtcaaggagatgtatcttctcatcatgtttcctctgtaggtgtgtgtgttccaaatttcctctaaggacatcagccatattagattagatcacatcctcattaccttattttaacttcattacttctgtgaagacctttctccaaatatgatcacattctgaggaactggagtttacttcatgtagggattttatatttttgtagataaattcagtccataacaatgagtctcatgtccataaaagaaaaatcctttgcttttgtgagatgcatgtacatctctaatttttgtaacacacataagcagatatatacctatagtttaagtgaaatgatgtacatatttaataattttggccttctgtcttcatatttcttgcatatttcagtacagacagcctgttatttaacatagactcacaacatagctaatcatgacaaaagactagcctaagacaaaattggaactcgagtaggttaatagatgcctataaatctcctactggtgtgtatgaataaatcacacatcacatgtgcctgctattcatctctcaagctttgctgtgaataaaaggcttacatttgttcctgcatcagccacttctaaaaattccaatgtagttattaataaagtgccattttgtacagcactctatttaagtagtatgtttcagtcatactcctattcaacaaatgtttactgagcacctcctatcactaagatactattgaataaatacatacagaaatgaatttaaaaattaaatgtcacagtgctttgtaatgtgtttggagtaagaaaaatacttcatcgttaggaaattttaaaaagcaaaatacttcagtgactgacatgctaccaggagtatgtttatgacatagtagttactggattttgtttcaagttaaataagatgccatttaatagatctgagcagcaatataaaggcttatgcatgaccctggcttattcaatagtttatttttttgtgtctcaaaagattagacatctaaatctgaaagaaattaaaattatatttcctagattaaaaaaaattgtaatcctataataaactgcatcaaatatttttctgtgttgtgaaaatagaccatgctctgacacatttctgttttcttctcaaggaacgataagaacacaattaccaaactattcgtgatagaaatcctgaaagtacatgcaaaaaaaaaaaaaaaaaaaaaaaaaaaaaaggacaataataatcccagaaaagggaggagttgaaagtgggggacatgtttgtttcttcataattttcttattccagttcttcaagaaacacttgtggtaccagtacttagaaattataaagcaatttaattaaaaaaaaaaaacttgacagaaggatttttaaagaacaagaaatagagaaaatagattttcctaaattcaaaatataatgtgtatatatatatgtgtgtgtgtgtgtgtgtgtgtgtgtgtgtgtgtgtgtgtgtgtattttatttttctgagagggacccttgctctgtcactcaggttggagcacagtggtatgatcttggctcactgcagcctcaatctcctgagctcaggccattctccctacacagccttctgagtagctgggactacaggtgctcaccaccatgcccagataatttctgggtttttttttttttttttttttcgtagaaatggggcctcactaggttgcccaggctggtctccaactcctggacttaagtgatcctcctgcctcagcttcctaaaatgttgggattacaggtgtgagttactatgcccagcctgaaaatataaagccacagattatccacaggctaattagtgaaaacagattgtggtatattgtgggacttagtatagaacaaggcttgattcataaaccagaggaaaatgagagactgattgttcaataaatgattgactatcaggtaaatagaatcagaagtgtatgttgacccctctttctataccaaaagtatactaatgatttcaaaagttaatgtaataaacaaataaagcctaaggaaaataataagtaaaattacatgtttatttatgttcagcaattgtaaggaccttgtgagcaaataaaagcaatggaaggcaaaaattaacaactttgacacagcatttttttatctgaatatcataaatcagaaacaaaattaaaagacaaactgtgaggaaaccgaataacaaatatggcaaagaattaaaaccctgaagaagtcatgtagatcaaagggtaacattaaaataaaagctcaatagggaaattgacaaaggggaggaacataatctatctaaaaagaaatacagataaccagcaaacaaatatactcagcctcacagagaaatgcaaattaggtgtttttttcctatcctttatttaaagatttttaaaagtgactactatacccagtttggtaagggggctgtgaaaacacgtgtccacaaatactacttgagggagtgcactttgttaaatattttttgtaggtaatattttagtatgttttaaaagccttatactgttttttgtttgtttgtttgtttgtttgttttttgagacggagtctcgctctgtcacccaggctggagtgcggtggcgtgatctaggctcactgcaaactccgcttcccaggttcacgccattctcctgcctcagcctccctggtagctgggactacaggcacctgccaccacacctggctgattttttgtagttttttagtagagacggggtttcactgtgttagccaggatggtctcaatctcctgacctcgtgatccacccacctcagcctcccaaagtgctgggattacaggcgtgagccaccacacctggcccatagacatgcttgtgaatatttatttgtagggatgctcaccacatttttatctgtaatagcaaaaatttttaacaagtatgaattatgaatttaaatgtctatataaattagaatatatttgtacattgaatgaattttcacagtgttttgaggatatccaatggtcactatgtcatgttaggtataaaaatgtaatatgaaattgcaaacttgaacatatagtagaatcctaattctgaaaaaaaaactaaaaaggttgatagtttacaactatttccttctttcaacttggcaaattttctaacatctctatattacacatatatttcatttatgtaacacccggttaagagagttgactcctgcctctagtctttccattaagaaatatagatagtgtccttgtctctttaaaatcaaggtcattataattcactattattgagctgataagagaactttcaattaagtgcttccagattaagcactactaagtctatttgaatgtgtctgctccttcttttattaataattcattgatactttttataataattctttttcatgttgaaatcatgttttgaaaacattaaaaacattggatttaataaaaggtagatacaccccatagaaatgaagctggatgaagaaggaaaataagtcagcagaaacactttgaatcaaaatattctgaataaaatcagaatattctatgatcttttcatttttatgccatttctagaaattttaaaaatgttggcaatggtgctatgtataatatactgcactagattgaaaagaggtagccactgtaattgaaaagattgctacacatttgaatggaccaaatgtgttttaagaccaaattcaagtaaaaaggatgtgtctcttctgaactgaagctcattaaatgtttcaccggccttcctgcaaaaatggattttcaaaactttggaaaggatagcatttaagctgaatttgacctgtattgaccattttggaaatcagccaagcaattcgcttgaagatacttgaagcacttgaaatatggaattgctggaaaaagaataagacagcccaatagctaccattgcccagggtgatactttggtaacaggactgatggcttgtataacaatctgacatgctgataggagttggggagtgggggcagccattgggaagggcaaagggaaccctaagagtagttttttctccctattatgactggctgtctctgagtaggttttgaaataaaagcttccatttttaagagaattgattggtcattgcgtaacgacaattctacgatataacaggaccatcccagttagtgctttgccctgtcactttggaggtccattagctcttccattcagtgagggtcctctatatcaaatggttctccagtaagtgctctgagagcagcagctaatgattccctgtggttgaagcaagtcagaatgaaaatggagttttggcacacatccctgaattccatcgacaggagggaatgaaggctaaaatatctataaatccaggccaggctgcagagtcactgcagattccctgcagagtggtgttaataacaaggtgaagaaccttagaagaatttgcaagttcatcaaagaagtgttcatgggaatgattgccatagcccagacataatttaagtaatttgcaatagccatattgataacaggtggtctaccgattgcttttgacaagaggaaatgaagaaagttataattattcttcctctctgtggacatagcttgtcatgatagtcttagaaactcggaaagcaagcaaaccaacaacacaatgaatgttattttgtaattccatgacacttaagcagtggtttacctcttctaattcgacctctttgtattaaaattagttggcagttagtacattgctttggatatggatatttaagtatcatgcaaaaaaacaaaaaagcacattcaaccaacacatcatttagttattagccaaagattactttattttaatgttttcttctgtgattggaatttagttattagccaaagattactttattttaatgttttcttctgtgattggaatttagttattagccaaagattaccttattttaatgttttcttctgtgattagtggctctatctgaagcaggaaatggtgttttttaaggaggtcattatgacttgggtttgcttttgtatccaagaattgacacaaatttgtttatttaaaataccttccctgtgtgagttggggtaagacatacaagaggcaaatgtgagtgttcaaagctgagagacctgagttcaaagtcctactcagctttctactaactctgattttttgcaagtcatttaatcagaaccttcaatatttaatttttttaagatagtctaatagttgccccaaaaggccaatgaaagaattgaaagcaacatatagaaaactatgactgtgaaatagatactatgtatatatatgatagctctttcctctctcctttatgctcatattgaagccaaggaaaagcatatttcaagaatcccgtgagagaaattgtaccagtatcatctgccttatttaattaacaggagacttcggtttaaaagtggggaggggcatgccagagaattcctgtctactgtatattctcaggactcagaattcctatcgctaattttaatactttgacaaattagcaattttctattatttgttacattctgcaagcatttcttgatttttccctcattgcttttcttaacgactcttcatgggtttaaaggaaatattatttttcctttcctacttaatcagcgtaacgggccataattgtgtcaataacatgaaattgttgtcgattttgcaattttgtgacacaatacaataggctgttgacttttttatttttttattttttttgcagaaaagaaaaatacactttcatgtgaaaatgtacacactgaaaattatagattttacttgtggaaaatatatgattcaagaaaaatgaagtgatttacttttttcttaattctttcccaaaatagttttctgaaagtttagctatctgtatacttcagtgtttaaaatatgtaggcactaaaattcttaatggcataaaataaaaataatctgctttacgaaagcctacagaaaataatttaaaaggaacattttttaaacgcaggatatgttagcagcgaatatggaacccaagataagcaaggcgtgttcgactctacctagacagtgtcagatctctggcagttagtacattgctttggatatgtagcttttagctgctctcctttgtaagttttaagaccaggcttgtttatgtataactattcaatgtcatacacacacggagacgtgcacacactctttttgtttgctcccatgatgatttatttaccagctgtaaaatggggatgatgataactgtccttcctggcagtcattggaccataatatatgtgaatgtcaattggaagttgtaaaatgccatataaatgcaagatattgtagctatgcaaaacctaaaattacctaattgattttggtctgtcccttaacccttataatgagagtgctagcaactaaaacaccttgaaaattactggagtgtttttatagccaatagactccagaatttatatagcacttagaactttatcaaactttctttgtactagtctgattatttaaagaagatctcactatataatgatgtctttaaaatatttaattttaaaaagataaaaatctttttaaaagataaatattttttaaagataaataagaatatttttatttccttgcagactctttaaaaagtgttgtctttttgtcttctgtttttcctaataattcttatttggtctggctggttggattcaatgctccactgctactagcagacaaattatacatattcttgaccgaacgtggtggctcacgcttgtaatcccagaacttaggaggctgaggtgggcagatcacatgaccttgggagttcaagaccagcctggccaacgtggcaaaacccagtctccactaaaaatacaaaatattagccaggtgtggtgatgcatgcctgtaatctcagctacttgggaagctgaggcacaagagtcacttgaacctagaaggtggaactttcaaggatgcaataagccgagatcataccactgcactccagcctaggtgacagagtgagactccatctctaaataaataaataagtaaataaataaataaataaaacatattctctgtgattcagttttcttatctgtgaagtgggaaaaacaatattactacttcccaggattatttgaggcttgatataggtaaagttgagatgcctggtattgagtaaacacagggaatttggggtaagtccagtataatatagtaagttacaggtattgttactttatctgcacagctttgttgacaggtcagtgtacttgtgtcagaacttcttgataggtactcagagtctcccagcacagtgagtcttgtgcagagagttcaatttagatccactaatgggaataaaagagaacaggcacagatacattatttaaaaacacaataataccagatcgtgcacaagaacacattttagaatcaaggatcattgtaattattcaagtagtaaacttaaaagacaggcagaaataggaggccaccttttgttaggggaatgctcccttttgacagttcctgaagaaaaaacatgggaaaaacactccttaccacctacagtttaggccattcctgctgttgacccttcagatgtgtccccgaactgcctcaccaggcacctgcttcctgcctgagagtttcactatcttgtgagggatgggacagtctggaagcttctcccatgcagacagagcagagagagaattatgcaatattttgtatcccagataaaattatatagtttaagtggattatggattatttcaccaaatttattttaaaaattaagaacatatccataaatattattttagccagagatgatctatcagtacaaatgtgaacagtaaccttggtaccacaggccccgccgtgcaagcttcttgggtaaatatttcaataaaaccttctcaaaacaggataaagatggctcagctgttctgtggactctgccgaggcaatgagggaatttgccgtgtccttctgtggtctgcccatctctggggctactgaaaggattcttcctccaacctaagtttcacagcatcaggcagcacttctgggttcctgagcatgctatttctttccaaatcacttttgtctgatcatcatttacaaacataaaagatggcttaagggccaaatcacaatttttatgcgtaaaccaaaatgtcagtgtttgtgtaccagactagggaggctgacaccaggttctacatgcttcgcctccccactaaactctctcctttattgtcccagtggttcaggaattcaaactgcttcaaaataagacatttaaactctggctttatgtactctacttatttttagagataggttcttgctctattgcttaggttgcagtgcactggtacagtcatggctcactgcagccttgacctcctgggctcaagtgatcctccttcctcagcctcccaagtcactgggactacaagtgcacaccatcatgcctggctaattttttaaagtttttgtactggtggggtctcagtatgtggcccaggctggtcacaaactcctggccacaagtgatcctccttccttggcttcccaaagtgctgggattataggtgtaaaccacggtgcctggcttagctcccaaaacttttcaggcataatgggaaattttaataactttctctgtaaaataagcataatccaaggatgttccatgatgagtatgacatatacttgacctaattataatttgattacactcaaattcatagaaaagcaagactatcatatactatgtggatttttcttaatgtaactttcaccagaatgtacaacctctgtattgttatccccactttgcagaaatcagctgtgagtttcctgagtcactcagtgctagcaggctttggatgataatgaaacgagagagttccctgacatatgacaggggtgtggctcacctgtttttggtcgtcccccagctgaaacccctgaaggaggggaagcatgcagaagggcagtgcagaggcgggggcaggtgctttggctccacagtggtgtctggaggtggatacctgcaaccctccacgttacaaagctctttcagttttgccatctgcagatggcttgagtgttaatcagctcagtggaccctctgctttatcgcaagggcagggggccagtgtgacagccttctgtatcccaagctcttgcccagtggctcagaagaattggatcacatgcaggctggaaggatgagtgcaaggttttgttgagtggtggaggtggctctcagcgagatgatgaggagctgaaagtggggatggagtgggaaggtgatattcccctggagtggggctgcccagtggccagcctcctccagtcaccccctgctgaactcccctcagcatccagacatccctcctcttctctttctctgccgcgtcgttctgccattgctgatctgctggtctgccctggagcttgtggttcagggtttatatgggggcaggataggggaatggaaagccaaaaggcaactttttgggcatgaaaacagaaatgcctattcttattcagggatgcgggcatctaggcttaaaggtggggcctttgccagggaaccaccctcttcaacccagtattttcccatttcctgtccgtatcaataaggtagaagagagcgccctaaaacccattcttttcactgtatcccaactctgtgtcagtgcacgttaacatccaactactcttttatttcgttacctatgtacctacgtattacttgagaaaactaaaaaattgacagaagggccaagcattccttgttttatagaaaaaagccaaagacagtgtttccagagtttatctcagagtaaatctctaaaaatatgtttatttttttaatgctcacagcgattctggtggctttatgaatatcaggaaaatatttctactaaaggcagcttaaaatccaccttacaaacacacacacacacacacacacacacattcacacacatgcatatacacacagtctgtttactaggtatctggcatcatgcaagacactgaggttcagtggcaaatgagaccaaaagttccttcttgtcaataacttgctataagagcactgggaagccaacagaatctagtgtggaagggaacacaatgggcagattctgaccatactgggcagtgaagctcatatttgggattatagggaaacgcattctaggctggtaaactgagggaaaatatcttcctcaactatataaaatccctcatgcaagttttatcaaatgagaaattaaggataaagtgaaaggaataaaaaagatgagagcattacacctggtttggggaatatgtttttagaaatatacatgccatatgtgaggctatagaatggcactttttgttctattttatgtacactcagaagtaaatgacaatttaatacattcttttatcattctgccaatgtttattaagcattttcaatgttccgagtccactgtaaagtggtaagaatatagtgatgaatgttctcagaaaaactcataagagaggggttgagttggatattttctacttcaattcaatatgacaagttctgtgatagatatgagctatgctcatatctgttttgtgttgctgtaaaggaatacctgaggctgggtaatttataaagaaaaaaaaggtttctttggctcatgattctgatagttgggaggttcatgattgggcatctgcatttggtgaaggtctcagggtgcttccactcctggaggaaggtgaaggggagcattatgtgcagagatcacacaaggaaagagggaaccagtggtgaggtgccaggcttttttcaacacacagttctcttgggaactaaagaatgagagcgcactctcctctgagggaaggcatcaatctgttaatgagacatctgctctcatgactcaaatacctcccaataggcccctcctcccaacacccccacaatgggggtctaatttcaacatgagagtatgtggggacaaacaaaccatatccaaatcatagcactcatatgtacatagaagattccaaaaatcagtgctcatgaagccaggacgggcttcagagaggagataacacattaatttgcatttggaaagataagagcctttttatttctcatttggaagcctactcttgctggccaacaaaggcttggagagttgagctgctattggagaagtttctctttaaatccaagagggagggaaatttcaaaattactttagatgcaattagaagtaatcagcttcatgtcataaatttttgatgcaattggtcccttcctttctggattattttttctctcatgtccagatggttctcacaaacatatcagaagatgatgacatttttaatttctttcactcaagctctgaatttatctgaatggaaagtatagagaagagtgcgattcttcaagcctaacaagtatatcacactgattaaattatgaaattaagattttttaaattcaaaattaatgtataacttttatctacatatttgagatattcacaaagacaattttattgttccaatcaaaaattaattgtattaacattttattattcatgtatttatttatcctgagagtcttgctgtgttgcccaggccagagtacagtggggcaattttggctcactgcaacctccacctccctgggtcaagcaattctcctgcctcagcctcccacctagctgagattacaggcatgcaccaccatgctcagctaattgtagtatttttagtaaagacagggtttcgccatgttggccaggctggtctcaaactccaggcctcaagggatccactcaccttggcctccctaagtgctgggattacgggcatgcgccaccacacctggcctgtattagcattttagatgtaggaaatgatttttcagttctaaaattttcctaaagaattaaacatatccacttaaggatgcgttgaccactgatcattgttgaataatgaaactttagggatacttactggcacattcaagtgaaaatgttctacaattccctaggtagtatttcttttctctaactgagctgctgcgaggctcgcatagggtgaaagtaaggtaactgtaaaggatgtaccttgttatgggtcaggcagcaggttaccatattggcacatatagcaacacatgcatacagcagagatcagagaaagaaagtttgtaagaattcctaaaacaggatagctttctagtttctcaaatactgctttctgatttaaacaaatccaaaatacagttatagctaacgtcagagaaaggagttattaattcagctgtagaccattaaacaaacagaccccaggcttaggggcagatgggatgcttggagatgtggatgtggagagacaaaggcaatgccaagaggccagtgtgcttagagcctggcctccctggagtcctctgacagcaggtggatcccaatgaccctgtgctcctgaagggcagaaattcaattaggaactctcaactttcagctttgaggctcaggctagtgtatcagtgggtagctccactgctggaggaaaaacattctgcagcagttatgaaatagaggctaataataggacaagggagagtgaaaaacatgaggttggaaagcattggcagaaaagatgagctgataaagtatctactttaaataaggtcataattttgccacagtttggggtgttctcctgtgctaatttatagtcacaatcaaaatcacatggaagccttattttctttgacaaggttttattttcagtgcactagaaagctctttcctttctgcctgggttagcatatgtgaaagaaatagtgattattttaatgatattaaatagtagctttgatctcttccccctacaagctaaccaaaacattatctggatgtatgaaatgattcctttgtgagcaaaacctctgtatctattataatgtttttgttcatctacctgaatctcccactaggctttgagttcatctgtgcttccggaacctaccacctactcaggaaagataaactggatcaatgaaaaatacgctaaatacctaccactctcattttttagacgacaaatttgaggtgttaaaaatgagacagaaatgttaatatcaatcttctatttcaaacctactaagcccaaggcaaaagcttacaccctttctacactgcttcataattgcctaccttgtgttcatgttaaatatgcaaagaaacgttgtatccacatttgatacatgacaagaaggagactcccagagggaaggtcgcttcctcaaagacgcccaccagtaggtaggaggtctgatcgccagtctcagttctgcctgactctaaagctctcgatcctccaatcttgtcaaatttgctttattataagaatcaccaaaggccatggttataaatatagattctcaagatcttcctctgaagattctaatttaggtatcagctgggacccaataatcacgcattcattgttgagaccaatttgggaaacagtgaataagactagtgtttctcaaactctagtgagtgtatgaatcctgtggggatcaactgcagattacggtacagtggtaggtctggggtggggcctggggttctatgtttccaacaaggtcgcaagtgatgactgtgctgtgggtccacagccgcacttgaagcagtgaggaactaagccttgctgctcagctcacaataggacccttattcccaccctagaggtcctttagtaattctgccactaccacacaccctccaactctgtgcagcccagcaattatgccagagcaagctttcctgcatacccttgtaaacatgtttgtgaagcttatggaaacgtctgtttatctgtatgagttaccctgctagttcacatacctaccaaataagaatctctgggcacctgcgacacaacttcatcccatgcccatctcatccacgatggttttaaaagccaactgtttccacaggtttctattataacagggggattttatagatcacatttgctattcacaggtttagcctggacaactgatatttttcccaaacagtagaacttttaagttgggggaaaaatgttctctgcagcattcagataaatggatgaagaagcacttcttagaggttgccaatcatcacacctctgcaggacttaagttcatctaggataactcacccgaggctttaaaaaattactgatttttagctgggtgcggtggctcatgcctgtaatcccagcactttgggaggccgaggcgggcggatcacgaggtcaggagatggagaccatcctggctaacacggtaaaaccccgtctctattaaaaatacaaaaaattaaccgggcgtggtggcaggtgcctgtagtcccagctaccagggaggctgaggcaggagaatggcgtgaacctgggaggcggagcttgcagtgagctgagatcgtgccaccgcactccagcctgggcgacagagtgagactccatctcaaaaaaaaaaaaaaattactgatattttttataactaggaaagctgtaatgtgtaaacatgacaaaacgccaaaacgctaagtgaattttacaatggaacatggacttttcaaagggacgattctgattagtgaaatctgttctaaacctcggcttttctgattcctagcagggtgacccttggtaatatcttagctccagtggaccttaatttcttcattgtgaaatggcgtgattgaacataattcctaggtctcctcgaattctaaattcaggtgaagaaacagggtgatccgtcgcaatttcatctgtttcagtatatgcgtttatgacatttgtatcaaagaaaagtggagacatttcagaaacagcaagtatttcctgagaaaacatagctgttctatgtgttgaagcacaaaagataaaatgccaaattaagaagggtgtgactgtcaggggaaagacggcacacagaaaacctgttagtccttcatgccagtgcctcacagactggctatctactcacctgagcagcttttaaaaatccattctgtttcagtaggtctggggtggggatgaaattctgcatttctaacaagggtctgggttccaggggtgtcgctgaacgtgcgtctggccttatctagcaaggctttacaccggagctcttccactttagctgcagagttgaactggccagattcaacattcagatagcccgaacacatgcagagcaaacaaatttggatctctgtaagtgggactaaggcatttgtcttttaaagctgcctaagtgatttccatgggtagccctggttgagaatccctgctctactcttctgccacaggcctccactggggcttcccaggtccttgaaactttgggtttcgtttatttatgaacacatttatcacaatggtagaatacaaaataggtatttcaccctcactttaccataaccagtagagtgaaaccgactgtgccaagagatcatgctatttatctggtggggtcctttacacactcacagaattttccagaggtggtccttatgaagcagactgactttttattctgctccccaagcaccaatgctaccactaacaccgcttgtggcatatttccccatggctacatgggtctccataattgtcaccttcaagttacctgttaccatgctggtcaccatacccatgtttagtaaggttttccatggctgcatgtttacaagctttctgatcatctttcccttttccttctcatcctcactcttttcattctccctcttccttctatgcatattcattgagtacctgctctctgtctagcctatgctaggtgcttcattgcaatctgtacatggatgaagtacttatcttctactgcttctttggaattgaatactaagagtgaaattacttggtccaggaacatgaatatgttcatgactcttaacccaaatctctcttgcctgcattcggtaagcttctatttgctgattgaatatgtgtaagcttgcccctccttattatttaatgcttatgtctttgattgatgtatattttttatattctttatttggctgtaatgtgaatttaaattttacttttttctttaatagtgaatgctttaaaggcaatgagaaaccaataaagaatattaagcgatcgaataacttgctcattttatgcatgtgtcatatattttcatcttcagaagctaccagttcattctctgtataggcagggacaacaaggatgcctcgcagtaaatattctttgatttcaccagagcctcttagctttgcaaatatgagacatacatgcatcatggtcctgcaggatgagggtaagtaatctgagagaaagagagagagaggtgtatgtgtgtgtgtgcgcgtgtgtgtgtgtgtgtgtgtgtgcgcgagcgcacatgcgtgagttcatcagcctgcccgacaagggataacgtaacataatactcaagttctgggagggtagagaccaagactctaaaccgtgtccttccaaattcaaagccaacaggacttgtttgagaagagcagtgaccttattgagatcaatggcaggaagggacaccaagagcacaaaggggaaatgactaggagaccaggaaggagtcagatggtgacccaggcttaaatctaaacctagagaacagtcatggtgtgtctgtattgtcacatggtgaaagtgaatcaggctttcctggcttccctgctttgggcttttgagggtgtgtcgtataatcctgggaggctgggatttctgcaaataacgtttacaaatcaggttggattgggatttttggaggattaccacttctgtcactggtgccaccttgtggcaaatgctacagtaaaaacttgctgtagtgtaaccgatagaatttgaccatcatttcttttactaggcgtttgggctaggaagtgagaacaaatctaatatttggataaccagtgaaggggaaatcttgagctttcagtcactaaggataggtggaggttttagaactctcttaaattatttatacaggattgtttcgtttgttttttcttacttgttcagggagatctgaatagttgtaggggagagaatgaattggaggagtttctacctaaatgttaaacctcctccacactccccaacatcaacctggaaaagttacagagggaaagcattaagacatggaaaacattctgagaaactccagtgaaatacgtctgtgggagacaggaactgttgtgaacttggagtacgtgtgatttgaagcctagagcaggaggcagctcatggggctctggagctctggctctaagccagcaaagactgattcactttcaccatgtggcaatgcagaagcagctgggttgttctccaagttgtagatttaagcctggatccctgtaacttagggaaagagttgatggaattttctttctttgcttctttccttccttccttccctccattcctccctccctctcttctcttctactctcttctcttttttcttttcttttctttctttttgacagagttttgctctgttgcccaggctggagtgcggtggtgcgatcttggctcactgcaacctccacctcctgggttcaagcgattctcctgtctcagcctcccaagtagctgggattacaggtgtgtgccaccacacctggctaatttttgtattttttatagagacggggtttcatcatattggtcaggctggtctcaaactccagacctcaggtgatccacccacctcggcctcccaaagtgctgggattacaggcatgagccgccgcgcctggctgctgatggaattttctcttgcttctctccttctatggcctggtgtgctatatcactcacactagggaggctcagactataaggataagagcactagaagatctgagtagtattcgtggatggagagcagaggggacacaggtgggagctaattgggcgcaggcagccatttccccatccttctttctccaaatcctgataagtgatggactgcacccaaaggagtgtttcttcctcaggatgttccccctgggagattgaacatgaagcctggacctaagaaatggtttggtagtgttgagaggggttaactgtggcttcctggcacctgtgactctcacttcaagctcatcccatttccactctaacaccgtaggaggactgcaagtctaacgaagtctagccatggccccttttacattttcattgcctgaaaaattagccaacgcttggggggaaatgagcttcacaggcccaaataatgacagaggagcagcactatttcaaaagaacatgaattagagaaaatctttagaccaaggaaaggaaacagagacaatgatctaaagaagcgagaattgaaagagagaatactagatagatttgaaaaagataatccacagtaaaatgggtgcgataataacaatccttgctttactggactattatgaggattaaatgaattgatatatgcggtgcataggctataaagtgtttaaacatggagtataataaatattcactcttatgaaattttatattttgactcaaatgtagaatttggggaagaaggactctggtttaatatattgagtgtgaagttctaattggacattagtatctttgtatatatgtatattacatttgaagctcaatgtaaactgggccagaagtataaaaccagtggtttggcataaactgtctctgacattgtaggagaaaacttcaagtggaatggaagccttaacagtgatgtttgtagggcataaaaaaaaaggtttcctgaagaaaggtaggcagattcaacaaaatgaacaatccaaaaaaaaaaaaaaagaaaaaaaggaaaaacaaaaaagccacaaattcaactacttttataatattctcaaatgcaattttataatattcaatattaaattgtgtgaaataggagagcaaaagttttgttgccattcctcaatcctcctcaccaaggtttaaccacagtttgttggatatttaccctcagttctttttttatgtctaaaaaaaagacatgttttactcagtgtacatgtggagctttttacttatggcttcagggatctaactcatttcttaaaatgactatgttgcattccaaggatgaaaatacacactatttctaactatttttctatagacaagcagatcagattttttttgcaattaacgctgtagtaaaacttttaaaaatacgtattactcttgagttattggaacttattcacaaaaaaggtaattaagttccagttaaccagtatgtatagattctataatctgcccagaaacatgctaagtactgtatataaagcatcattgtgaaagataaaggcagtgagtattttaagaagaaggagtgattagcaatgtcaaacgcagcaatccagtagaaatacccatggatttagcaagaagtcaattgagataaaaataagagctatttgaattgtactatgtagtaagatggcagatttcaattagttaaggtgtcattagagatgggaaagtatagaaatgagtacagattaacactgaaacaaattatcttcatatacctatttgacgggaaaaacatatttttgagggattctagtagaagtgtacattggtataacaactttggaaaacagtttgttattaccaccagtcacattgcacatgtacctacactgtaactaatcacttcctctcccagagaaattcttaatattaacactccagaagacatggacaagaattcctagaataaattttgtaataacccctaatggaaacagccagattttcattaatagtagaatggcagcggattacattcatacaatggaatgccatccagcaatgctaatacctacaggtaaccacatggatgaaccacagaggtataatattaaatgcaaaaagcaagatttgtaagaagatgcagtatgatttctgttagacaaagttaaaaggcaagcagacaaaatggaatattgtaaaataataaatagcagcaagggaaccgtcatcaaaaaaggcaggttaatagttggtgttttgggggaaggaagaagattccatcaattaaagatgcatagagggctcctgaatccagcatgtttcattttctgacacagcggtttttgtatgtaatggtgatgttaatgatgataatgattaaagatcttctttaagaatggaatatgttgtaatggaaaacgacaacattacagagataacaataactaacatctattgatccttttgtattctggacactattctgaatgcttatttaatccttataaaaatcctttaagataaacatagctatcataccccattttatagtagaagaagctgagatacaaagcagttaagtaactcgtccaagcggcagagcaagaaggcgatcagcctccagagcttagattctcaacaacgtgtacaagattacctctgaaagactgaaaagctatttcatttgtgctttgatttttatatctaggtaactttgtagtcaatattttactctatttgtgagatttatatcttaataaacttttctcatattttattttatcacttatgcttcatgggttgggagactttatcacactaaatgagacacctttgagagtaagatgctataaacaatactcttggaaaacaagcataagctgggactgtcctggacaaactggaacacatggtcacctttcatagcaagaaggtgataatgcagcaaggccactactgatgaattctttcctttcttgtgttaacgtgttgcttatcacgtgagtttttgtatgtgtgtgtacttatgaacattctctttagtttggtttaaaccatatttgctcttttatgccatttcatattgctttaattaactttacttttaggagattttaattcctagcagtataagttctttttcttcactgttacactttatccaaatataatttgataatttaaaaatttttaaaaacatattttcctgttttataattgttttatttgtattacctttatagaaatacaattttattatgtttatagagtgcacatggaaaagaaaaatttgcagcccatgggatcattactattaattgctttgccttccagtcttggccagaaatattcatctttataatatttcattttatccttctcatatgtagtatttctgtgcatttattcaaatgtttttataatacttcctttagtagcttataggtttttatggactcattcaaatcccttaataattattttatcaggaatcttctcattgcttaactagtatgtgataactagttaagcacaaatttgtgttttataatgataaaggaaaggcacaaatttttgtatttttatttatatctagttaccttatgtactaaacatttttgttaggtagattttgaattgtctgccttttgcaggcctgtaatcctgcaatataaaaatagtgcatctttgtttcatagacttttgttaattttttaaaaatccagttctcacatactattttattgatccagcagtcgaaaccgatattaaatatgttaaagcttattaaaggtcccattattgtatataagactgtaaagtagttatctgtacattttatacataatgcatatgtataaatatattttaggcatagacataaatttctgcatagtcctttttatcaaaacccattcaatggagtactttattctcattaagctattcatatggtgtattaaactaatagttttgcctgtatagaaatattcttgaattcataggatgaatttaatcctactgcttaattgcaacctctaataatgtacttaagactttaatttaatattcattagtgagattggcctggcctaattcttattaaagctttattacattagatatcagttggcttttatttcacggaataccttcaaaaaggccttcatttattcattacatattctggcaatttgtgtaacactggtattaaagtttgtttatattttaaatgaattttccaataaatgaatccaccatatttgttttcggtagggtaattttttgacagcttcccaattctcatctctgctaacatttttcttttctataattcaggactgcattgtacatttatgtaatttttttcataaaatcaaaatttgtttatatcttctctctcttaaatgtttaagattttctgtccccaaatgagtgcatttagtaggctgttgcacatactatcagaaattccatgaattcatacctaaatttatttacttatttaaacaatttatgtttttccttttttaaaaaaaacacattttctttagcattgactcatttttgtgtaatttttggttaaattaggttacatgttttgtttgcttttacatttttaataatgaaagtacttaacaccatgattgtttttgctgagtgtgtataattgcttagttggttgttttaatagaattgttactatgtttttatttattttctccttcactcaattgttatttggtaaagagattaaaaatataaaagaggggattactatttaaatttttatctcaaagtttatgttacagtaatctgacattgtgatctgtaagcatagagactgcatttatacatctctacagctaaatttactgattttagaatgaggaagaattttcacaatggttaaataaatgataatttttctaaatgttttattaaaaactcaatgttcacagatacaaaattcaaactcttactatttaattatcctggttaaatatgtttctcattcttttatgtctttttatttttatcaagtggatgtgtttatgataatttatcttctcctatacttaaatattttaaaaacaattttactgcatcactaaacattaatctgctattcctttcaaatgaaacctttttgacagataattttgaatataattttatcactttttaaactgtcattattaattcacttaataccttaataccattatattaatattgacaaacttatttaattttattcacatttgagtcatctgatttttttctccatttgaaaaatgtctttaagttgtttgggtttttctttttctctaaatgcaaaacttgaaactataaaactttattttagtttttttttattttcaacttttattgtaaattcagaggtacatgtgcaggatgttacataggtaaaaatgttacatatgtaaaaatgtgccatggtggtttgctgcacagatcatcccgtcacccagaatccattagctattcttcctgatcctcttgatcctcccaacccccaccctctgacaggcccaagtgtgtgttattcccctcatgtgtccatgtgttattatcatttagttcccacttataagttagaatatgcagtatttggttttctgtttctgcattcgtctgctaagggtaatggcctccagttgcacacatgtccctgcagagaaaatgatctcattcctttttatggctgtatagtattccatggtgtatatgtgccacattttctttatatagtctatcattgatggtcatttaggttgattccatgtgtttgttattgtgagtagtgatgccatgaaaatacacatgcttgtgtctttataatagaaagatttatattcctttgggtatatacccagtaatgggattgtgggttgaatgatatttctgcctctaggtctttgaggaattgccatactgtcttccacaatggttgaactaatttacactcccaccaacagtgtaaaaacattaatttttctccacaacctcgccaacatctgttgttttttgccttcttaataaaaccattctccagcatctgttgtttttgcctttttaataaaaccattctaactggtatgaaatggtatctcattgtgatttgatttgcatttctttaatgatcagtgatgttgagctttttatttatgtttgttggccacatgtatgtcttcttttgcgaaatgtctgttcatgtcctttgcccacattttaaaggggttatttttttcttgctaatttgttaagttttttatagatattgtacgttagatctttgtcacatgcatactttgcaaagttttctcccgttctgtttctgtaggttgtttgtttacattgttgatagcttcttttgctgtgcagaagctctttagttttttcattatatatttagatttattgactgtatttattatacctattttcttctcagacaatcaagaataacaataatagctacaaagttctcttggaggaaagatataaaaaatacttcttgagcaaatattgtgccattaatatgcaaagtgtatagaatgatattcactggtaggcaggtctcaaatggtgtggagcaagcaccttttccaaaacatttctcatggtttttcttcttcactgagattgaattagattaagcgtaattaaaaatggagagactctatacaaggaataaggagggcaatattttataggtaagtatgcgagagtatatgaaattggggatttttgctataaagaggggattgttgctatagacagtaaattgatatgattttagatacaattataggatacaaattttgtttacaaatatttagtaaggtgtgtttataaaatgggttgtcctgctgaaaattgtaaaggggcaagaggtatagtgaaaaagaaaaataaaggcaaaagccaagcataatgttttagctattaaaccacatttctgcttttcatgttgtcttaaagtgagcatatattcattcttgcaattaggagtatttgattgtaaaactgctaaatacaaaaaaataaaacagataaatatagagtaatgctagcaagtagtaattcagttgaaggaaaaaaaatcacatcagtgaaatcacttttccatgaggcttttccatcaaatataaatttttatatagtttaagcacatttgtttacttttattcctcattattctaccctctctggtctagaataagtctaacatgggcatttttaaaaggccatacatatttaaacgaaaatgaaaagattaataactgtgcaagtattgaaactttaattatataaattctcaggcatgaaagtgttctttggcatttggctgtatgtaccattacttgtaatatggctccttattaaaagtcttttttatgcaagaagataaataatacaaacatcaacaatagagtggcatgggtttatttagatattaaactgttaattatgtatttgtcaaaaatcataaatcaggacaagttgagctggagaatgaaatattcagcctaggtctcattgtcatcataaattcctaattttggtttaaattaaggtatggacaagagtcttcatagaaacattttcaactcttctcttcttattcctttctcattttctctaaagaaatcttatcgaacatttaatctcaaaggtcatgaaaaagtatgattgacccatattgaagatatttttactactttcctttatactcggaaagatccactttttcagagacacattaaaaataactacccactaatatgtcttatcaaattacttcttggaggctgttattctaaacacaggagttagttcagtcttggcaggttttctttttctcttctttttatttatttatttatttatttttgagatggaggcctgctctgtcgcccaggctggagtgcagtggcatgatctcagctcactgcaacctcctcctcccgggttcaagctattctcctgcctcagcctctggagtagctgggtttacaggcacacagtaacacgcccagctaatttttgtatttttagtagatatgggatctcaccatgttggccaggttggtctcgaactcctgacttcaagtgatctgcccgccttggcctcacaaagtgctgggattataggcgtaagccaccgcacccagccttgacaggcttttccaatacaccatgtcatatttcatttttgccaattatgttacatgctttagctttattttatttttttctttttcttatggaaaatggaaacagaactgcttttacttttaaacttatattggcttgttttaactcctcttatgttttatcataaaacactcaaaatatatatgcttttaattccaatccgctcattgtcttaaattgtattttcaaggaaagaatggaatgcacacaactgctttgattgtcatttctatttccagttactcatgtaatggcactgccaggctggttggttggcattgtcttaggtgacgcatggaccatttcccctgtcttccagctgtgggcgttataacattcttgtttttcagaatgccagtgaatgtaccctaacaaacaagaaaaggaaagactgaccaaatctgaacattttttagctggaaaacatgtaaatttaatacttttaatagatgaaccctcatgttagcatgcaaattagctgttcctaccaagtcaattggaatgtgacagttaattctatacatgcatcagcaatgacctcagaattggctgtccatcaacttccatggctatgaactcacccaccatctttgttctagaaagactttccattaaaaatgtaagttcatgattaaatcaaaataagataaggggattattttaacattaatataacaccagaaattacatttgtttctgtggaggaatgctctgtttgctttggaaagaatgcagatccttttcatttatacagagataatatatatttttaacctgtcagaatggcaaagaacaaagttggatagcatgttgttgatgagcaggtgggagcatacatatatgtataagtataaattgctacaatgaagggcaatctgtttctaaattagaaaagtactgatcctgtgacccagaaatttcatttctaagattagatcttacatatatcctagtatcataaaaatgattccacaacacaattactcatcacttcactgaaacaacaaaatattggcaacaattgctcatcaacaagagattcattaaaaaacattatgggactctcatgtgggatataataatgtgctgtaaaaagggaataagaaagtttttttatgaacaaatgtggacccatttgctgagattattttaaatcaaaggaaaccaaggtaaaatgtaactatttacgtaaaaagagaatgtatttgcttgtgtatggattttatatatgaatgatatctctaaaattacatctgagaaactagaagtattggtgactagtggagaaggaaaataggtggctgtgatcaagatgtgagacaggtaatttgctatagaaccctggatttccctttaaaaataataaaattaatttaagatcatgtaatatggtaaatatttggactgctgatacttctttaaaaatcagtaaactttgaattgtgtacatttataacaaacatcctggcctctaaatatgtgaagaagtgcagaaatcatatcagtggtaaaaaaggaattagtacaagatttcatcttagagcatccagactctaaattgatagatatgtaagaatgaaagtttatttaaagtggaataatgtatacctcttcctgtgtccccaagatggcatcatctttctaacattgattcagcttgggcttgagtgtctgagctgtgtctcacaaactaagctctccataccatcggcatcaaagtcatttgctggagtgtgttaaaataaatattttcgaattctatcccatacctgccgagtcagtgggccttggaaaggagcccgggaatctgcattttacaaaagatcctcaggttagtcttaaaccaagattctagaaccactgttgtaaagcctggggaatagagaggagaaaatactagaactactcattaactggttagcacatgatggcatcttcttacaaacctttgtgtgcattcacccccctaaccacaaagcaaaatgagcatcagaaccttcatttaaagacaggaaaattaagtatttgtctttgtgtaattaagtgacttgccacaggtgacagagcgagagaatgcaaatcagaattcaactcgcaaatttctgctttgtccatgctgacaggaatagcatcattgtaaataaaaatcactgtgttagtgtaactttgaaaagtcaatccctcagtaaaccttgctctgcagtggaaggtcatgcctttctcagcctttcactacctaggattcacaggagatcaaatactttgctaaaaagagattttcttattttacttcacattctcatatctttatgcattactctcatttattcttcagagaacattctgctcagattaacttctgtaagcaacaagtatcccacatatattttcaacggccagctagctattcttaacaggaagaaaaaaatacaaacattggtgtgtactttttatatggcagtagacaaacgagggtaactggtgaatatataagttaatattctgaattaataaaatgaagacacattttgaaatcaacattacaggtaatatccaataaatagctttatacatatacacacactcatacatgtatatatgggtagtttctggacttaaaatagattcaaaaaagtttccattatgtaccagaacaatagctggtcttagggagatgagaacacatgtagagtctgactttatgaagtcattgacattaacacgtatgataactctcaattgtgaaagttaattctgtcagaaatgctgtgtgacaggcctattagagcggctacttgggccatttattgtactgtggcctatttccgacaagtcagataaaccatggtttgaatctccactcagtcaaaactgcagctagtcacttaaccacactggtgttcaatttactgtctgtgtagtgaattgaacatacctacctcaatgcgtttttatgggaataaaacaagagtacaaacctatctgtccactagtggtattttttaccttaagtcacattccttcaccactaatagtggttaagttttctgactctcagtgatccattttcaaaaggccatctctgaaatttttgcctctactttctttaatggcatttccctatgtcactgcttaggtgatatgatttaggggaaagccatattttacttgagttaaagtcaagtttgtttgtgtttttttgtgggggggctggggtggattgttctcaaaatgatttactgacattctccagcataagttttaggtgaaagagtattctcaggtgggaaatttgagtaaatcttgaggaagaagtatattctttacaaatcatttagggaaaattctctttaaatagggggacctacttatgcatctgatttgcccgtgacactcattgtttacactttcacacctacataattattaataatgctcttttactttcaaaaatgtgtagtttgaataaggtgtatgaaccacctaattgaagaaagttacttgtcttaacctagaggttagctagctagcatcaagagtttaggggaccaaaaatggtaactctctaggaaataaaaagaggaattcatctacttctctgcagaagaggactggtaaatggactaactttgcattcaggttgtaattagacaaaacagaaagtgtgatcaataatgcaagtgcatagtggcagaagagagcatggtgaagtgagcctgtagacacacttgtgcaatatggggacagctctgatgtggcctgggctgtggaattcagtttagggggaagtgggttgggagtagtggtaaagatgaagtgagtggattgggccctggcttccggattacaaatgtacttttggaaaaacaagattttgaatagtgtgggtgtctatgtaattactaaacaaggacattttttagcttttggctcaagtgacaaagattttcctttcaaaagcattttgccagattgaaatctaaacataaacgtatgacaacattgctaccggtagctaattcagtgattcaacatgtctgtttatcaaacacttgagagcactttcaaagagccctggtttgggtatgaggtagagttttgtgaggcttcttttaaagcctctctgtctgagaaggaatatgctacttttcataccaccttgccagaaaggaaggcccagaacagaaagaacacaaaagaggtataaggggttaagggaacctggaaaaacctttgaaaagtaaattatcagtttagaaatgctctttaaatgtcaacaaagagtcagcaggcagtgtgtcagctctgcacctggccacatttcctatcctctgttgcaacttagtgaagctacgtggccaaactagagccaacggaacataagtgggagtgatatatgtaatttgggggcattttccacataaaataaaagctctttgccatggaatccctttgtctttccccttcccatgtgtggtcacaggaatgactatgacccaccttccaatcatgcagatgaggataatgcccaaggggataaacttttggggaaaaaatgagtccactcaccaatccatatttaaagacttatatgtgtggaagaaataagcttttgtgtgttttttagtcactctccttcagtctctatactacagcagttgaaatagaccttacataatacacaccctttctaggtacctacaggtcttctgcaaaagcagccatacaatcttcagattgtgaccaagttgcttttaaaattctcatccaggttgcctcttttttctctctcttggttgtagcaattctcatcagtagtgctgccaaagttgaatcctctttcgagcacatgcaaaaaaaaaaaaaaaaacaaaaaaaaaacccacgaaactaggaaaagcattagaattgccccatgtgaattccactcacatttcaaagccaatacatgtaaaagattaaatgaaaatatcccatctactgttatcacactctgctgtcttcaccaatgtgaactgagaataagagatggcagcttttcaatgtattgcctagattcctctggcttgtagtgctcccgtcatttctatttcctaccatgcttctgtgataaagcgagaaataatatgccaaaatgccactagcattcaatacagggtatgctgtcctctacaattagcatatttttttctgatagaccaagtgtttaggatgcaatgatttataggtccaggaaatatatagacagttgcttggatgaaagaagggtatgtaggaagttgactttgtgtactaataaatgccaaaaggtacattaggttaaggaaattatgtatgaaggagtctggcgataaattactgttgcatttttctgagttgaattgcttatgtgtctgtataaattgctaagcagaaaataggctaagagcattaaaactttagttaactcttatttcctcaggtctatgtaattttaaacttatttaggacaatagcccatttgttttacaaatcacagtgttcattgcaatatctttcaagctgaaagcactaaatcactttatattatggagacctggaagaatgcagcattatagcttggctggcagaacatgtatcagtgagatattgatctaaccaggaaaaagaaaagctgtgctgaatggactccacactgcaaggagtgttatctgcaggctgcagtgtttgttcaaatcccatattgctggaggtgaggtcatatatatatatatatatattttttgcaggcttcatatgattttagtgacagttatggccattttcttaatctgaaagattaagaaagttgtttgttgaagaatgtctgtagataattccttgacatcaggagtagctcacctttctgcaggaatgggttaaaatggaatgttgatcaaatgctctgacttcttaagtatggtttgtctatacttccaaacctgtatcacagaacccctctggaccctttggcaattcaaagtatcaacactgagacaaaggtgtagctgtcagtcggaggggatattgtgtagttgccttaagtagtgttttcctagaagacccctcagaagtaaagaaactgaaacagaagtaagacatgagtcttaattggattatgctgagattaggatactgtgtggctctgacttctcatctcactttcaaagaccgaggagacaggtgcatccgtaatttgcatggggtccaggaaggagccctgtgggaaagactcagctctgtgtacagttagcattaggctgttccaatatgactgattgacatggactgactgacagaaaggattaaagtcctggaaagagaacaacagaagtcattgccaggagggaatgaaatactgtaaggaagttaggaatctgccatgctgaggataaggaaatagagagctgtgtttgaacccatcttcattttgtcccttaggaatgcatgtgctatctggaaggataaactagaataatcatatcaccagaaacataagtgagtcagctgttcgattcactcctactaccaagagtagacctctagaggagcagcatatgcatggcaactagacctctgctcctggcgtagatgtgggcccctggtcagttttcataagtgcttattaaaagaataatggaatggtcatcagcaagctcctgttagggatccacttactgtcctgctggtacctgtgcactctatgataattcatatttggaactgttttattccctttattgtatgcagagggtattttgtgtggtcagagattcttccatgtgcctgccaagtgattattcacctttttattccaatatcctatgtataattgcacctacacactcccatacaaatcctaatgcagtgtataggctgtgtattgctatttagtatgctttgtctccagttgtgtctctgagcccaggtccccctccataacatcacactgtgctatttctccaacatgctggcagacacagagctaacaggaagcctaaacagagcatttccctttgggttgagcgtgagggggcttcttcttcctctctcatgtcacactctgcttggcatgctctccagtcctctaaggaacagatgcaggagcacatttacaaagcaggactacgatgagcgggcacccgcgaggcttgagatgtgcccagcctcctccctaggcaggctgccaaagcaaagctccctcatgtaatagcttgggcagataatgggtagacacaggaggaacaaatcaggaagcaaactcactgtgggcctgattcccatttagagggtgagacatccacagtctgggatagtgagaaatttatggaatgggctcttttttccatttctactctcttctttgctgtggttcctcaaacaccacttggtgcacagagctagggaaaagcaacagagcttctgaaatggcatttggctaaaacacccagccaatcttctatttttatttaattttcatatcagcagtattttattaaaaccattagtaaaatacagagaatatctaattttagaatgacagcattcaaaccatccgttacaaattgattttaattaatgtggtttgtcataattaataggttattttgactctccacagtagccttcatagtggtagatgaggacctgaggtcctctctcccacagctttgcaactgccaggtgttacattacaatggaagtaagtcttagcttgaactcttctgtgctgctgtggaatgaattatcggtctcaattcatcccttcccagtagtattaagcacaacctagccatgcttcatagtgggtccacaatttccccactttttgatttggggttcagatgtgtaacttgctttggtcaatggggagtctgcagataattggaagtagaggcctgaaatgggctcatgaattggaattgctttctcagtttctgtcaccaccatgagaagaacgtatgccagatagctgctgccaattcattgaaatgagaccctcaaagtacaacgcgtaaatgcaagatcagctgaaattcagctagcccacaattccctaagtcatgggaaatatggtgtaggtcactgatatatcaagcttgttgcacgttattgtggtaatagttaattgacgtacatatataccaacacataccagcaagtaagcacacagaaaattatacaaccaattctttcaggcactccaccaagcacattgcagatgtgaaaatatgatcagggcaggattctgctcacctgattgaaattcagggatagatccctcccttagtagactgtccatatgtcaggtacacacagctgggataatacctttatcctagttgtgtaaaaccagaataaataatatggacttatagtttatctgatctaggccgaagtcttttaaagtaaattatagacaatatggcattatatatctgtctatcttatcatctactcatccttccatcattcatccatccatctatccatttatccatccatccatcatccatccattcatcatccatccactcatccacccatccatccatctatccacccattcatccacttatgaatccaggcactgttgctttccacagtcatgtgggaatgtaaacatgaccaattaaagctgagtcagtgcaatgtgattttaataataaataggagaaattattattgccccatgacctttaaacatttttgtcaaaacattgaaaatgctcttaccattagatatagagaaataaaaaaatagaaagactaatatttatttagtaaaatgtaatttaagatactagaaacattaagaatttaagtattttatttctttattaaaatcttatcaggagcggtttgaacagggcttggctttttctcatggttatgtaatctgtagtatggagggaatgagttttttaagccttggcaaattgccatactcctttcaaagactggatgagtttccaatatcttatccttttgagattttcatggtgtgaaatatccccaagagttttcttaatgtgaagatttttttgctgtcctccctcgctgcctctggaacattttttttcatccttcttgtcactaccactttccatatttatatcaataactttccctttactaagttcctctagctgcataatggaagctcccaaatggcagaagtgccaatatttccaaggtcacctagtgctcctataatttcatttacatttaattcaaattccacttccagatttattactctttgtttctttgttgttctttcatctttattgaccagttccctttttcaattgtccatttgataaatgagtttatccctgggggaaaagggggcaacacagctacacacttgccgtctactcatgaacaaatatatgcacagcaaccaatcgctgactgacttagaaagaagtgatgtgattggtcattggtcatgaatctgttatttacatagtgatttgttgactgaagagctagcaaagaagtttgtagcttatgtaattacttgcaattaaggtaatggagtaacttaaatttgaactgtgttgttgggtgactggtgttatttaattaaactgtgctcagtgaggactgaccatatttatttgtccctctctcactctgtgtgtgtgtgtgtgcatgtggttaaactatggatttctaagtcttttttcctataaaggtaatagcaatgctttatagctgctggatatggtcacttaaagaatttgctatcaaccccttagaatctgttatcaaccctttagaatctgtagtctctgtttccaaatcacaggctctgtaacttttctcattcttgtctttctgtgagtctccaatgtcaggagaactgcctctcctgtgagctttgtgccttcctgttgtgtctgtcatccttctccccagcatggggcaattggtgtccctctgggagttttcagatagtaatttgcccatcttggaaggaaatggtctccctttggcctccttacttttctcagggtgtctgttctcttcttgcaaatgtctagactcctaagactattgcctccacagcctggaacttttaatgctaatattgtataatctggtttgccagacctcatgcctggtttagaatgctcatcgggaagaaaaaggtgctcccaaattatgtggataatcttgaagttgaattattatttagaatacaaaatgtatacattgaaaagcaaactcatcttgtaaggaaaggaaacatttgcatttcatagtgagaacatggtttgtctaagcaagaaataaaattaaacatagtgagccaattaggaagaaatgatctgaatatgtatcattgtgacaatattaactcatgacaatttctgcttgtcccattcagtatcttttagacatttctaatctagagtcagtgcaaaagccactggccagcttctaaatgccagggttttaaatgcctgtcaaaaatgaatttgttaccttattttttacaaggacactttgtaatgcaaaagggcaaaataccatactctcccaggaaatatgtggtaaggaggctaaaccaatatttttctttttaagatagataacatccctcttcacaaagagaaaagagtaactgttgtctcctctaaactatctttcagacgtttaatgagagccatcttatcccagcgagtaaaaggcaaataccagctgcctcctgagagaggggcaaagaaaggtcaaggaagacctcctgctgctggctttgggggcatctgctgtttttctcacccacaaagggcagtctgtctttgagcacttacagtgtatgcaaggagagtagcccagttctgacctgtcaatcactaggttagactctctctgaaactctcctttaggcaatggcatctaatctatgcaacagtcagagtgccagacacccagggcttgggctaggcttgcagggctcgctggagtggcccttggatcttagaactaacagaatcaagggaagtgggaaagccaaggccagactcagcagcagtagtcctgtgaaagagctagactatggggagagaaaccaaataggagctaacaggtcagctgtggacagcaagagaaagagagaggttttggaatgaagggaagtgattacaatctaggaaggttactgaaaacccagggcttgtttttcaataccttttgttaggtcaatatagcctctcccaaattttaaaaggagttttgaagagggctaagctaatttgaacaagtgagatcaaacaactttggttccaactgggatcttctagtcatcttggcttcgtgtatgtgtgtgtgtgtgtgtgtgtgtgtgtgtgtgtgtgagagagagagagagagagtatgagtgtgtgcctggcaacggtgaaatcagtaagaggttaacaagttcttttgtttccccagttgaatttaggcatagtaagtaaacaaaccgacattttaacatgtgcttcagaaaacgggaaaggtaaaagtcacttccaaaaggcccaagaaatgtgcacatttatagcaaagcaagggtgagtggaatttgagtacataatatagagaagcaaacctatggtagtaccaaaaattccgccagtgatcattcctgggcttcaggacctgccatgatgccctggaaatgaggcagaaggaatcagcttgagctgcttttccgacttgatgaaggcattcctcctactgcaagtttctcacccccacttaagtacagaaggaagcaggatacaccaattgcttagagtatttccaaaggatttaatgcaagactgtattgaaatatgctttaacaacttctacaatttctgagactatgacaagtgatagttaattttgacattgctgactgtggctgccatttattcttagcacagttattcattgtactatctggaatacatgcctcctttttagttaaattagaatcatgataattaacaaatatttttcattgaaaaagtacattcacctaataagcaaagaaacataaaagaccaaaatgactactgctatgatgaaagacaggataatttttttatttgttctagacgtaccaaatagaagggaattacaccaactcaaacccagggcacatgtaaataaataaaagtataatacaaaatatctttcttaagatgtcagaagaaaatttagctattctgaaactcaacagcagaaactgttgtatttcccatactaggagtatcaataggcaagtgtcttagttcgagctgctatctcagaatattatgcattgggtagttgatgaacaatagaaatttatttctcacagttctggagagtggatccctgagatcagggtgcctacatggcctggttctggtgagggtcctcctccaggttgcagactgccaacttctagttgtgtcttcactgggcagaaagataaatgtctaaatcccttcctcttcttaaaaagacactaatcctatcatagggggtttacccacaaaagcttcgcctcttagtaccatctaattgggggttagagtttcaacatattaattttgaggggacacaaatatgcaatctataacagcaaggcattgagagtggagatttatatgagccaaagcagaatcacagacaaatcatcaacatggttgttggcacataggcatttgctaattgtttcctttatttaatttagcatttggaaatatataaatttatctacagaaataggattatggaggcatctaaaactcctctgttgtacttctatgccattcaacaaatacctgctctctgaaagccttcaaattgatgtctgcccttaagggagatgaatgggagaagataactagcagtgagcaaacactatatctgatcgtttacagatattaaataatttaatcgctagaaaaagaaagcaaagcatagataacatatataattatcccacttttagagatgcagttcagagaatttaagtgataaaattatctagtaataaacagcattgtcagtaatgttagtaataaaatctgaaaatactaccacttatcaaccacacaccacgcagaaggacctgggctaagcactagatgtatattttatcctctcagcatccctgggtgttggctactgttatttaaattgcataggtgagaatatgaatggttcctaagaactgtgcttctcaaaattttatctacatacaaataaactactgatcttgttaaaatgcagcttcagattcactaggtctaggtagaacctgaggttctctgtttttaacaagcttcagatgacacacatgctgctgatccatggatcaaacagaaaagctggggttgagaggtgaagtaactcggtcaagtacatgaggcagattctttttttttttttttgagacagagtcttgctctgttgcccagtctggagtgcagtggtgtgatcataattcactgcaacctcaaactcctgggctcaggtgattctccctcctcagcctcctgagtagctaggacaataggcatgcaccaccacacctggctaattttttttaattttatttttaatagagatgaggtcttgctatgttgcccaagctggcctgaaactgctgagctcaagccatcctgctgcctcaggctgccaaagtactggaattaaccagcatgagccaccatgcctggcccagattgactctcagtggagaaaagatcaaactgttatttgtttagttcaaaattgcaagtgcatcttgccaccctgtgctatctcttccttgggtttggcaattcagcttagtggggagaatgagatgtgcacaaggatgactatgagactcagtactaatggcaacacactctcagacagaggcaaagaattccaccaccgtctctgccactcagggcttcctggaatgcagaatatctatgagtaattccaaatggataaatgaggatgattcccaaaaagaggtgtctggtaagctaaacctagaagactgaagaagattttacacataaacacataagaatgtatatgtgcatgtatttatatatgttatattgtatacatatgcaatataaatctataatatacaaaatttatacatacacatgtatatgggtgtgtagctatatataatgtatgtatataaattatatgtatatatgaatatgtatgtgtatattcacacacacattatatatagacacacacatatacatatattttgatatctatcttttgcttctagatagagagaagtatgcacagattctatacagtatgaggcaggatcacaggacagcttggtattttgaatgtactttgattccacagatcatgtagatcacacagtattttctcttcccttctcttacatgaggggcacccggatataggacacttagagtagcttattgatttgcttctctacttgttagtaaaatttttaataataggggctatggaattcttgatcttagaatacctagggccctagatcttgtcaattcacaaaaataattcatttgaattatttgatgttcttatttcagttttatttgaattaaattgcttttgatatttgcctttagtaattcaacctcattttcttaagatttataaagtttttatttggcattaatttggaaaatcagatatcgtaattaatttaaagtcatagaaaataaaaatatgagagcacctagaagtttgtaagatgatgttctattgctttattggctttactcagttatttaaaacaaagtttatatgcaataaaattagtataaaatccaactgatattgagaaatatcaacagtaattaatcaaattaggtttctatgataaaacctcattattaaatttgattttatttatgttgacattttctaagaaacatctttagaaagaaagcatttgaaatcttctgattataaatatttagcctcttatgttatcataagaggcatatctattttaaagaagccactgagaagctgtacattaattaagaatactatttattaagaataaatagtcatagaaataagggtgctggtagttatgattccccaaatagaatgtcacttctgttaaccacaatattcagccatgaaccttctgaaatttcaggccaagaagaaaataaagtcatgtctatagctgtgcctagttagtaatcagaaggttgagtttgggggaaaaaacaagcttttctccttttctaaccaaagaagttgtttttatttggtgtttgtttatttattttcagctgttgctcaagcaggttcctcaggtacagactgacccacacagtataacaggccagatggtacgactttagaactttaagtcatatttactatgtgagaatttttttactcatttatttccttcttcatctttccagggacagcctgtgaattgtgcagtgaattctttcagtatcactaacctgaatctttttataatatcctcttttacctaaattttaaaagaaatcaataaaacttttagttattatttggcattcagaattagattcaaatacgtctatgtgggtgcctgtgcgtgtgtgagtgtgtgtacctgctggtaaagacactgaagacatcattccagcaaaaattgatcactgtgtttttggatttggtcccaagttattttctgtgagatcctctttctcatttttgcttttgattttgacagaaatgacagctgaaatgtatctcaataattgagtttttaactttttttaaaaagatagcttactcaaagcaactgttgttcatagctgttgtaatttaaaggaatctatgtgatctttgcaaaaataactttcctaggatgaggtcaagaatgagtaatgtacaaccacagaaaagacgtgacatgccttcttgtctgaaacacgtgaagacacaaggaagccttcatgctaggtaattatttccagaggagcttccatgggacttcataaaagcattgacttaatgatgaaatattgactctattttctcagtgaacactctattcatttgagcatcccatcattcaaaccttgtaaatcctttcacagtcttcgggaatagggtccagattgtcatccgcatcttgtcttcagcagcaaaaaaatacacactcctcccccactcagagaaactgccctttagccaacattttgtgtcatttaattatttgcaagattcattaattggcaacagcccttccagattttccttagaattaacaatattccactataatttatagattatgtgtcactcttcttcctcagcttgaaaagggcatacatatttcaaaatcacttttgaatcttgaaatttaaacattttccccaatgacatctattttaatgcacatgatttaaaacatgagcttttgatataaaataaagatagtttgaaagaaaaatagcagcctctaagttttcatatggttcttcctcctggggatatttctagaattgaaaacacttaagagggtgcagaattctttgtcgagtgcttgcttttgcttatttagaaatagagggacaatggcagagaggggtatgaactctcctttatcagacctgccttctgggctcatttctatatcttatcaataatatgactttggacatacaattccaaatctctaggtcgtagttttcccatctgtaaaatgggaaaaccctcaacctcaacaaattttttggggggttaaaagtgaactaatatatgaaaaacaattttgtatgccctgaattatttatggaattttgtaacttgaggtttgctgacctaagttgtgaggttaaaggtttagatattggaattatactaacttctaggctgaaagtgagctctgccattcatgctcaagactgtttgctttctgacattttaggtttttattctttccaagtatttatcacaattagggagaaggcattcaaaccttagtataaatggttaatctgaatacagactaggaagacttgggtcattcaaattcacaaacctgtgtaagactgcattgctcaccccttcgggatggtttttcttggtactcattggactgcaaagggtagcacggtactgtgccaccccaagacgaccttagtaagaagcctgggtaggatgcagctgttcaggggctagtgtctgctgggactatgaggttctaatttaacctcacctaatgtctcacttctattattatccaattttacagccagtccatgtgaggcacagccttgccaaagttacatgactaaatagagaagctgcgatttagaaccacattttctcactccaaatcttgctatctcaatcattatattgtaccttatttgctgaatgaatgattgaatgaatgaatgaaggatgaatgggtaataaatagagagacattttactacataaaagctttcctaagttatgggaaaatatttctgagatagttatttctgtatatttgctaagggattagtaattttcaaagttaggatgccacatgtcataactggagtctattacagttaatcttatggggtctgagttaatgcgctataatgaacatggttgtaaacagaaaggacacccatttttgcattaaatgccattagctggtctgagagcaccttgagattatgacatactcctcattttgccatttttttccctgtcagcatggagcacaggttctggtagagcgagagtgctttacaaagacttgctgaggatgagtggattaaatctttcactcatccaaccgcttaagtccctgctgcactgagttaggagctgggtctagagtggtgagagaatgatccacaatttctgttctgatgaatatttggaacaaatgaaggagtgctccaaaggaaattgggatggtgtgtggttgaggacaatgagggtactaaacaaagtgaaaaagacctcagaaaagtggtcgaacgaggcctctcttggcaagtcacatattatattagatatgtgaaggtgatgtttgaaggaagagagtgaattagaaggatgtgtgcataccaggggcaagcgcatctaagggagagcagcccttgcaaagaccctgtgctgagagtggcatgctttgcctgagaacctcaagaatggccatggtggctggaacaaagtgagtgaagggtagagtaggaagagatcacgtgttaatggcatgacagagattgttcatgaaagtaccttttctatctttggaatgatctcagtagtttgttttttttttttttgaaatggagtctcgctctgtagcccaggctggagtgtgcagtggcatgatcttggctcactgcaacctccccctcctgggttcaagtgattctcatgcctcaacctcctgatgcacacctgagtagcagggactacaggtgtgcatcaccccacctggctaatttttgtatttttagtagaaacggaattttgccatgtcggccagactggtctcaaacttctgacctcaggtgatccacccgcctcagcctcccaaagtgctgggattacaggcgtgagccacagcgcctagcctggagtgatctcattctttttgcttagaaagattattaaaatatttcgcaaatgattggaccctgagtagattggcaagttaacttacagaactaggtttgagaaagtttttctctcagatttgaattgatttgcttgaatcatttttttttctaattttgtccaaccattagctctggaatatggtacattaaaaacaatttgcattgctccattgctgctaatatcaaggtcaatattgtcaaaaggcatggagatagaaggtcaagatgatgcctcaaacagcatcagtaatttaggacagcctgtcacaagagttaaagtgattgataagcaggaagaagtatgaacaattcattataaaggggactggatgacttagatgttaagcctactttaattttctgcatagcaattatattgctgattcacatatgaaagtattaggagacttgggataattgcagctgaggacacatcttttccattgttcgtgggacataactaaattctctgataaattaatcatagaacttatgggaaataatttaaacagcaacaacaatgataatacctcatatctctacagcacattgttgccttcagagcactttcaggtaggccattagacaaaccagtgagggagaaaaagactggcctgggaaagttaaatgaccctggttccactgaaagttcatggaaatgcagatcttgtgttaatcatgtcttctccttcagtcacttctcaattctacctcaaaagctcagactcttaaaggtttcacaccttgccttgcattatgtgcttgaagcccagcaataacactggaacttgggtaatgcagatatcgattgcccaatttacagacaaagaaactgagttgcagggaggtaatgtgacttcagtcagagaaagtgatagaatactacattctgactcctgaggattttttttcttattaatattttgagtacataaaaattgtctaatcccatgagcttgggagcttgttgacttagaaactaggtcttttgtacattgagacaggtaccgttttcctctatccaaagacaaaattgaattattttctgttacgactattctctaggatgtaatttatttttagggacctttcatttccagacttccagaagattcaaattggaatcttcttatcatcattactattctttttattattttcatatccagggtgtctataaatcctcttattttttttcttgttctactttccccagtaaataaccttttgtaagaaccacccacccccgcccccaccattccagtgtctttttattttattttttttccagtgtcttttattttgatcctgcttcaattttagaagatcacaataagaaataacatggggagagcagacctaatagagattaggatccatcattagacataaatgagacacagaagagaacaattaaaattggaatcctacaggtatgaactgttaccatataatgtttttttaaaggtgttagcctttctcatccttaaattgccttcaacaggaattctctttttggaatatgtaaaccatgggtgggatacagaagtaacctactctaaatggaagggcaaagtggtgataagattgggtttttgaatcagataatcttgagttcaaacctcaactctatcacttatgaatttgtgattgtgtaaaagttaaggaacctctgtgtggtagttaactcttctgtcaaatgggaaaatgactttgtccctcataaagaaggtgtgaagagaataaagacacacaaaataatgccttactgtgcttagtttagcttacagatggatttatgtcaaccctagatgtgcgtgggtggacagctgatcactgttattttgcttttatgactactgtatactgaacgctcactctgccaggcaatctgaatggagctagacattcagtggagaatgaaagacattagatccctctcctcatgaagtttacatgttaaaatagaaaaatataggccgggtgtggtggctcatgcctataatcccagcactttgggaggccaaggcaggtggatcatgaggtcaggagttcaagaccagcctggccaacatggtgaaaccctgtctctactaaaaatacaaaaattagtcaggcatgatggtgcgtgcctctagtgccagctactcaggaggctgaggcaggagaattgcttgaggtgagctaagatcacaccactgcactccagcctgtgtgacagagcaagactacatcgagagagagagagagagagagagagagagagagagagacagaaagaaagaaagaaagaaagaaagaaagaaagaaagaaagaaagaaagaaagaaagaaaagaaaaagaaaagtaacaatttggaaatgtacttcgaaggaaactaataagatgttattacagaaaacagaaaggacaggtacttaaagtggtcagagaaggccttttgagaggatgccccaaaaagagtatacatcgtgtaatcaaatactgtggtcaagactgttcagcacagtgcatatcctgtgcaaaggctctgagatgtgatcaaaaccacttaaaactgatgtatcatcaaggagttcatgattcaattcaactctccttaagtaaaagatgaatgtacctttttcagacatgatattttaactagctcatgaaatagatcaatttagcacaagaagtatcttttcacatgaagttaaatggttaaatttataaagttattacatattacaaatctatactccaattcttgatgaacgtttcaagaacatgttgacttttctcaaggaaaatgacaaaactatacatttcatatatatattatatatatatatatattcttatttatttatttatttattcttctgtgattttcctcagtggcatttgctaatcatctagtccaggaaagctcttgggaaaactatttatgtaaggtagataccatgataataataacgcaagagagaggaagtcacatagactaagagtggttctgtatttccaaggaggaatacattatttattgctgagaatttatgaaaaattttgcagaataggaaatctataagtcctaattctataaacatgatgaggaaacttttccacatgtggaatttcattttaataagtgactatatataatgccatatatcagcattatgcttagactggcacagagggtgtctgaagggaaatgatagatggggaaacctaggtggccccatgtaataggggatctgtattttaagaagtttaggcctttttattttatggcagggagaattcagtccaaaaactatggaaggtttacggttagaatgaaaattttctgagcaagttatcaagactatctaccaattacttcaataattaggcctaaagtaaagcatttctgaattagataagtcatttttatttgtacagaagaacacttcattaatatatttcaaaccaatggcaggtttacaagttatttaatagtggcatataagcataaagcagttggaagaaaccaatagtgatttggataatgcttgtgtatatattttcaaacttatttataaataataaattagcactccattaagaacacatgagatcatgatttggggagtggaaagggagggaacccatgcccggataaacaaagagtctaatgaatctaatgagtctgagctgggtagaaaatattaatagtagtcaacattctttcatgaaggacgtgggataaaaatgtgtccattatttgtgctggatgctgagtggtctggatggctcattgtcagaaaaaacaactttcttcactgcttttttgttctagtaactcttgctgtataatacgttagcccaaaacttagtggtgtgaaacaactgttttattttgctcatgatttttggcttatgaattataaaagaacccaggtggacagttctctcttgggatccctcacactgttgcagtcaaacattttctgggctgtggttgattggcctgctcatataagatggtttactcaggtggctggcagttgatgctggctgtcagctggaaactcagctggtgttgtcagccaaagcatctacatgtggctttgtcagctttgtattcttaaaataatcagacttcttatgtggcaactggcttcccaccctgagcaagcgccccaagagaccagagggtagctgagcctgcatggtcttctgtgacccagccttagtagtcacccagggtcaattccttcataccgtattgttgaaagcagttagtctacccaggcccaaagagaagaaacatagagtccaactccttgtaaaaagagaattaaggtttttgtttggtaaagatgatgactgctacagatttcttaatgatttgtggtcattaagaaatctatggctgggcgtggtggctcacgcctgtaattccagcacttttggaggccgaggtggatcttatcttatgtattattatattctaaacataatataatggggaccatttcttaatgaaggcattgataatgaagacctcaaaaatacatggagggatgccacgacatagttgaactctgatacattatgtaaatgaaagaaaccattcagaaaaggccacatactgtatgagtccatatatacatatatatatatatgtatatatatataaataaaatgtccagaatacacagaaaccacagagacagaaaatagattagtggtggctaaggggtggagggaaggggaaaatggggaatgactgataataggtatgggatttgggggagaagagtgatgagaggttgatggttgtacaaccttctgaatattgtacaaccttctgaatattgtaaaaccagtgaattgtataatttaaaagggcaaatgtttgtgatatccaaatgtatcttttcttttcttgtatctcaagaaaagaagaagttcacagatgaatttctaaaatctcaaaatactgtgttatcaattccaaaattaatattcttgcatacgttagcactctggaattagtctcatgatagctgtgtgattgttttctctctcagtagtacacaaagtgatgttgtatcataaaattcactacattttaaagttgataaaatatggtatatttctgattttacttatcaccagatacaaaggtaactattgcaaatctgtatttcaaagaatttacactggacaaattgttggatagatttgcctcaggctcctgagcagctgggattataggcaccaccaccatccctgactaatttttgtatttttagtacggacaggatttcagcatgtaagccaggctggtctcgaactcctgacctcaggtgatctacctgcttcagcttcccaaagtgctgggattacaggggattacaaagtgctgggccgctcctggcccagtgttttttacttgatatttataaggaggaaaggaaggaagaaagaggagaaaaagaaggaggaaagatgagggaaagataggacaggtggaaggaaagactgattttaccaaatgacgtttgtttgtttttgtctaccttaattcaaaacaagctcttgctgggaggaatggaggctgaggaagccatgaccaaaagtataattagtatcactgcaacgagctggggtaacctcaggcatgtctcagagcctctgtcgtcctcaaacatcaaatgaaggcatcaacaattgcaaacgttcaaatctactgatatttcctccactccttagttgttctttgtctagaaaactccagcctaatctttggactctgaacactcatcagaaaactatgatgtctctcttaagctctcagacatttgagtatttactctgagttctaagtgaataactgtttgagaatgagtccttcactaaattgtaagatgctccggggtcagaaaaaggctattatcttcacaactgtggcttctgacaattgtttggccaagtgctcagttagtatgaatggagggaattaaggtggggccttagcgcaccagaaattccatatcttaggttttaggtaacagaggcctaaattctggcagagcagtaatagaaagaaagttaaacatgtggctgagagaaatcaagagagatgggaaaaagaaagcgagataaactgagtccttattataggaaaaagttgattctattaatccaagcaaagtcaagaagaagaatgagtctggagtataattctctggagtggcataggagccattagcatgattttacgtttcatgtggataaccattttaaaaatgtcagtagttgtgtcttaatgtgttatagtaagaaaaaaaactaacacatcaaatttgtgatattacagttaatgtttcctaagagtgggcaaataatgacagggaattgttttaattcagttgaaagaattataatgataggtaaatgtaggtatacattgggaacgttgtggtttcagtttccagaggtttgagaccactgcaataaagaaaatggtgcaataaagcaagtgactagaaatgtttgttttcccagtgcatatacaagttatgtttacactatactgtagtctataaaatatgcaatagcatcatgtcaaaaaatgtacatatcctaattaaaaaacactttattgattaaaaaaaggtaacaatcatgtgagccttcagtgagttataatccttttgctggtggggagtcctacctcaatgttgatggctgctgactgatcagggtggtggttgctgaaggttagggtggctttgtcagtttcttaaaataagacaacaatgaagtttactgtatcatttgactcttcctttcacaaaatatttctctgtagcatgtgatgttgcttaatagcattttacctacagcagaactgctttcaaaattggagtcaatcctctcaactactgccactactttatcaaataagtttgtgcaatattctaaatcctgtgttgtcacttcaacaatgttcacagcatcttcaacaggtgtagatttcatctaacaaacaaacaaaaaaacactttcttagctcttccctaagaaacaatgcattatttgttcaactttttcatgagattgcagcaattcaatcatgtcttcctgctgtacttctaattctagttctcttgccattttcactacatctgcagttacttcctccactgaagtcttgaacccctcaaaatcatccatgagagttggaatcaacttctttccaacctttgttattgttgatattttgactatagatccttaatagtcttaatggcatctaaaatggtgaatactttccagaaggttttcaatttacattgcccagatccatcagaggaatcactatctatggcacctagggccttatgaaacgtatttcttagataataaaatttgaaagttgaaattactttttgatccatgggctgtggaatggatgttgtattagcaggcatgaaatcaacattaatcttggagctctggggtgaccaggtgcaattgtcaatgaacagtaatattttaaaaagaatctttctttgtgtgagcagtaggtctcaatagtgggcttaaaattagtaaaccatgctgtaaacagatatgctgccatccaggctttgccattctatttatagagcacaggaagagtagatttaacataattcttaatgaccttacagtttccggaatgataaatgaaccttggcttcaacttaaagtaaccagctgcattatgtaacaagagagtcagcggttcctttgaaattttaaagccagtcattgacttctctctagctatgagggttttagatggcatcccttccattaaaaagctgtttcatccatattgaaaacctgttgtttattgtagccaccttcatcaattatcttagctagatcttcttgattacttgctgttccttctacatcaacatttgctgtttcacatgtacttttattttatggagatggcttctttccttaaacctcgtgaagcaacctctgctggttcccaacttttcttctgcagcctcctcacctctctcggccttcatagaattgaagagagttaaggctttcttgtggataaagctttggtttagggtaatgttgtggctcgtttgatcttctattcagaccactaaaactttctccatattagcaataaggcttttttgctttcttattatctgtgtgttcattggagtagcacttttaattttcctcaggaacttttcctttgcattcacaacttggctcaatgtttagcacaaggagcctggatttccacctgtctcagcttttgacatgcctccctcactaagcttaatcatttccagcattaggttaaaagtgagagagaatgtgactcttccttttgcttgctcacacagaggcggttgtaagtttattaattggcctaattttaatattgtgtgtcaggaaataggtagactgagaagagggagagagaaagggaatggctggttggtgaagcagtcagaacacacataacatttattgattaatgtcactgtcttatatgggcatggtttgtgctgcaccaagacatttacggtagtaacctcttaaagatcaggattacagatcatcataacagatataaaaatcatgaaaaagtttgagatattaagagagttaatgaaagacacacaaagacaggaagtgagcacatgccgttggtaaaatggcactgatataaacttcctcgatgcagggttgtcacaaacctttaatttgtaaaaaactcagtatctgcaaattgcaatcaagtgaagcacaataaaataagctatacctttagggtccaatctgtggagaaaggaatgaataaatatggttatatcaatcagggttcccccaagagacaaaaccaacagaagatatatgtgtgtgagcacacagagagagagagatgattgattttgattttaaggaattgactcatataattgagtgttggcaagttcaaagcctgtaggcagaccagcaggctgaaaacaggaaggattcttgtattacagtcttgaggaagaactccttctttctgaaaaccctcagtttttgctcttaaggccttcaactgatcggatgaggctcactcatcacccattatcaaggataatctcttttatttaaatcaactgatcataaatattaatcaactctataaaataccttattagcaacatcaaaactactatttcaccaaacaactgagcaccatcatttagccaaattgacattaaaattaaccattccagagggaaacatttggtgaggtcagatttacaaataatgagttgcagatactgctggattatatgggtaaaaatgctcagtgaagtcttagaaatgaaagcaattcatgagcaatcaatctgccttcactttttcacctatttttattcagaaagtcacttagtctggaaaatgtcgttcatatggttgcatgccctattgttaagtgaatgagtgtttcaagggctttcctgttaggtttatttcatttagctctgttgcagcattacgatgtaagtgcttaccacaaaggtttgctaatgagtgcccttaatttgtattcagatgggagcaaagagaaggaaaaatacacaagaaggagtcttgtaattatgctacataaaattattaggcaatttagaaaattgtcagtgggaaactgcccatcatgcataaaaataattttgattttgatgtacagagtttaatgtaagagtgattgtagggagaccatgttattaatttttcccttaattatccaagcacacttgaatttattttaaggaaagtgatactttataaagttgagtcacgctactccagagaatacttgttttcgttctgtgacaaagtttattttgcagggcttgctgtgaactgtataattggtaggacgtgaaagaaccattaattatgtccttccccttcccctaatcataaataacaaaatgatgctatattttctggcaaactaaagtatatgtgatgtaaagatgttcaggtaatttgtgggcttatctattgtcttaaatatagaactacttttcactcatttttggcatacacagttgtgtattcagataattgtcagtgcaatgctaaatgtgttatgttaaaaaatgatgaacatattacctctcagttcttgttatagataatttcttgcaaattttaagctagagatagtcaatatttaatcagagaacatcttcccaggattcaaagtataccacatcagctgttgaatgcagttaatttgcattaatgtgttacaaatcaatgttctgtagtattttaggaactgtaaaacatacctttcaagacaaagtccaaactctttagtatgcaatatgtagttaacctattctggaatgtctcttctaactgagagccaccctgtagggaattaccttagtcttttaattcctgtttgtatcaggtgacttagcaaccacctgcatagcaggaagacggcaccaaggaatatattcatccccttacatagtttgaactatgtgaccaagaaattacagtccatttgtatagagtgccaagctctgaaggctggaagacatgtaagttcatgtataagcataagaaggttgtccatagaatgaaaagagaggaggagagagttaagggccatctgggctcccagagaaagtgagctcaggtcccctttgggccctaaggatgaaacaactgccctttgcctggattcacttgactgggttctttgctgtcattggtagacacatagagccctcctgtctgctttagtcttgttctaccttctcagcctcatatagcaatacctcttatattctgcccccacccaccctgaccatctcagtgatttttgaataaatcttgtctttcactcgcctctgcctttgcgtagaggatacctgctgtgcaaaggtgatgtgagaaagtcaggtctaaattcacctccagactctgcctttggtgggctgtgtaatattatgcacatcacttcaatccttagatttctcatgtctagtatggaggaaatagtacttaacatggagacttttcaggaaaattaagtgaggtattatccacacagccctcataatggtgcccaacactgtggttatcaatagattttagtaccatttttgccagaaagttgaggcagattctaatccaacttttaatatccagatctatccattattccctgattcagtccccaaggtcactcattctttcccttcagctccacaaaaaatccacttacaaatattttatacactaaatcacatcataatcattatggatttctccaaaattaaagtaacaactttttctggttctctgaaaatatgaataaaagaggctgataatgctgcatgcccagaggtgaacatggttcaataagagagagagaccttgtggaagtgatgctggaattgaaatccaaggattgagtagtggcaatggaagaagagaatagtattccaggcaaaatacatggatatagattccaggggaattatgtatgaagaaggagcatagtgaaacttaggccctgcaaggccagtgcagcagagataagcctgtttccttgggtaatggtagggactgtagggcacagtgaacagtgtttatgtcattctataaataatactgataggaccacttattgagtacttcttacatgccagaagttctttggtgctttcattacattaacttatgctattgtccacagtattctaaggtggttgctattagatttccaattttacagaaggggaaactgaggcacggggcggtgaagtaactcccagaatgttcacagtcagcgaaatggtggattctgaatacaaatgaacacaatgaggctccaggtttcctgcttattatcaccgcgaagcccagcctcagcgagcaagggaaggagctagagagcgggctcccaggcacatctgcatgtgtgcactggccttgtaacatcagtctggctcttaagagctgatcagaaagaggacagaaggggagctggcacactggttaggtgaaatgagaaagctcaatgagtgatgatggtaattcagactagaatagttagtgttattttgtgaaaggaaatttcaatttaaccagagcaccttgaagtgaaggctttgaattggaaagaaggttttaaattgctatcagaatttgccattttagtgattgaaacattttagggccaaatgtgccatgctgcacctttccagaaggaactatttgagggaaataactgtcagctcctatagtaccagtgtttaaaatgtaagtttagggagaaaggcagttcaccttctctccaggtggggactgactgaggtgttgaacaaccagatttggggatggtattttttgaatttaattaactgctacatgtgaactagtaagatcaaatcacccacaaggtagatatttgagaaactcagtgtaaatgtggaaaagttgatgttatgttccaaagatgtaataaaaaattaaccagtttatgcaaatgtttatgcaaattaaccagtttatgcaaatgtttatgcaaattaaccagtttatgcaaatgaaaagaggaggtaagaaggtataagatgctatgtttgcatcattcactgggaacatttgaactttgcagattaatgtccttggtggaagaagttatgacattatgttatttgttggggaaaaaccctccagtgtaaagacttttatttatttatttattaaaggcaggatctcactctgttgcctaggctggagtgcagcagtttgatcatagcttactgtagcctcaaattccagggctcaagcaatcctgcctcctcagcctcctgagtagctagtacaatacatgccaccatgccctgctaatatttttttcttttttttttggagacagagtctccctatgttgcctaagctggtctcaaactcctggtcttaggcaatcctcgcacctcaggctccctcagcactggattacagaatacttaaaaataacataaatcagtcagatatttaagcctcacaaacttttcctgaagatttactgagctacttcttcagatgaaaaagacattttgtaataaatggtttctgaaaaaccaaaccctcaaaattgtaactgggatggatatgattagtgaaacacattaaacttaaccctacagggataaaccaagagcgctactgatgtttataaggaaatacaagcattacatcttaaactagacaagtttccactgctgagctaccctgagcttagtgaaattaactattttcacaaaatggaaatccattaatggaaatgacatcataaattcagaaaagattcttagattttaatatacttttcctaatttaaggcaaattgagccaccaagaattgaaagagaacatatttggataattgaaaggcagagtttaaacattccggaaataactatctgcactttcaaatgcaaggtcttgcttaggtttggaacaacacaggttttcttgatcacttgtctaaaacagtaactgagagccacacaacacaacctcgttttataaaggttgtctctgatacttagaaaaatctaaatgtttctgtacttttgcaagttactaaagtctttccattaaattatttgacttttttttctcccgcccaaaaagtgattagcgcacaacaaaatgtgtgtgatttgttaatggagtattctttcattgcagatttatatgttcttaaaacagtgcaagccttttgtggaaataatgtattttgaaatcatatattcttatatacatgtctctaaaagttcatcaaataaaacgtaggaatagacatttttacaaacagaaaacagtcatgtggttctgctatccaaacacagtgacatgatcttttagagtttattttcagtcttttacatattgaccctgtttttcctccatatttgtattcttttaggtttgtttacagagttgtaatagagcatttgtgtgaagcagtttatatggtaagtgacagaaattcagctcagagacactaatatactcacaggatgtattggtctatattgttcctctaggaaggtgtgatccagaaactcaagagaagtcatcaaggactcagtctctctacatatttttcttcctttataagtaaatggcctgcaaatcttttctcatttctgccgctctccctgaaggacctggtagagtacttccttttgaaatatctggctgcagttggcctatagctcagtctgggtttctggcttgttctgtgcatttgtttttcgtgcttcaattagccattgtgtcctggtaatggaaggaaacaatcctcagagatcttgtcacactaagtctgtggcacaatttgaaacattcagtaataccagctgttctaagcagaacagaagtcataattagggatgcaatgatttcacactaaactgtagttacagaatatataactacattttaatgctcatcaatttttatcttatactgtatttatcttcaaagaacaaatgaaccaagtgaattggatttcagatacacagagctggatttatctaatattccctttctcatcttctgctgtaaaaaaattatttcttcttatgtaaactacctaagaagtatcttttcctcccagaatactgtagctttgtctgctcaaatccaaattatataaaatggcaaagctgctctggaacacattttggctgtttaatacacagttaaacatacaatttccatgtgacctcatcatcccacatccaggaaattatcctaaagaaataaaattgatgttcatgtataaacctgcttaataattttttagaaaagtaccattgccaagaactggaaacaacccaaatttccttcagtgggagaatggacaaaaactatggtatatgcataaaatggacaataaaaagggaaaaattattgatatgtgcaatctggataaatctgtagaggcatcagtataagtgactgtagctagattaaatactttgtaattccatttatgacattctgaaaatgtaaaagtatagggacagattggagattgccagggattggcagtgacagaagggtgtgttaattacaggggcagcatgaggcatttctttatggtgctgggatcatcagtatctgtttgtgctggtggttgcaagaatcttcatatgggctaaaactcatacaactgtatagcaataatgtgaatattactgactgttaaataagatatctatgagtgaaccttcactaggcaaataaaataaataagtattaacacctgtgactcatatctgttgtcattttccaaagcttgaagcccagcataacatcatgcttggttttccaattcatcatgcttttgatctttgtatgacacatgcagaatttgggaaacatcttgggagataatgagtttttagtaatttgggagataatgagtgctatgttgggataagttaacacttgttttgttaaatattacatggaagggaatagagaaaaagtctatgcggcaacaatgatgtactcttagcatgacacatggaagcttatgaaaaattattaaagactttgcactcagttaccaaaaaaaaagtctattatgtaagagatctggatcacccccagcagatgtagggctgaattgttggttgctgttcatctgtaaaaaatgaatttcccaaatgcttctctagtgcttattcagctctgcttagagaagttttatccttgcatttatttttttcttttcgtggccatagtgagaatggtattaagaactgggctaagccccagttctgcatctgcttgctcctttaaattagtgagagcaagctcattctagttcagttcctgagtagctgtaattaatggtttgtagtattcacatggcttttgaaaaggacccctttctctctttaaagcacctttaaactttctagaaaaaaaccatgtaatactgccttgaaaacagtcccttctgggtgtcatttcaactactttcggttcaacttcaagttgtccagggaaaataaacccatcaagtagtgcctgcattgttagcttgagaaccagaaggaacttcgaccacatttgcttttgagaatgtaataatttacatgtgatatatgatcgtttagttaagcaacagtgatacagaggagcttcaccttggcctcatccattgattgtgcagatttcaatacacttgtttaagctttgtggatgtggttgttcattcaatcaacagaagtttacttttgcctatcctggaccagaaatcagacataagctcaggatattaaaagatgcttatatgtgtgtttggggaaagggataagaaaatgtagagaaaacagagaaaagtacatgttgtgagatatgtttgataaaatctgggttgatcaaatttaaacaagattccagaatttgtaatgtattaatatgcacaatgacctttcaagaatggaatctaatgtgcaatgattctcaaatctctctgactgggaaagcccctgttaatttttctcagagaactttataattgtagtatccttttctacacactttgcaaaatgtatggatgttagcaaaaaaaaattatcttttatgtattgattattatcagcaatgcttcttactgcctcagagccagagaaattgcaagcagtgcctgaagtgttgtttgccaagcttctggtaacatacaacattgttttttgttttgttttgttttgaattactgtttatcaaatagaaatttagctatgtcagtggtcagaattgtggaaatagtatacatacaaacttgttttgttttgggaagaactagatgattaaggcagctttgctatgtggtaaattatattttatgcctgggtaacagttgtcaactaaaaatgggagatttgctgtcagaacttgttgagagtggcatgctcagtgtataagtaggtttcctgccataactacattgagtatatgcattatataaatgatatatgagtttttagtaatttgaagagaaatgtaatacctaaatacattttcctttctgttacttaccccatatagttttgcaacatttagtgccaagctaaggtgacttttgattattgaattaacttcttaattccaaagagtttgtgcacatcaatagaattttgttcaaataaattagactatagactaaaaacaatttctagaaaaacatgttggcttgccacttaagattatttctctgatgtctaaaacaaattgaaacttagtttcaatgtagcattgtatttaatataatcataatttcaactgttttaggaaaatattttattaataaaccaccatagtccatcaaacagataatctgtattatactagcatgttagcttaaaatgattttgtatatattatcgttataattatatatatctaatgattgaagaaagagaactgatccactacattgttgttgaaagtgaatttagaatgagttatatgttaatgcaatcttgctatctttggctgattctggaaggagttgaaaccttaattgatcaatcacttgattcagctgaaacttagagtgaagatttaaagtgttcttaatttgatcaaaatggcaatttttttttctgaatccaatatgtggagggaaacacaaggaaacagtaattaccattatgaaagtttcatgaaattatggtgacacttttaagtctattttttaaagagctttattgagaaacaattcacatactatgtaatcccccttttaaagtgggtcatttaaaggtgttgatattcacatagcagtgcaatcaccgccactatttaattttagcatattttcatcactcagaaagaaacctcataccattagctgttagtctacattcgcccattttccataacctgacaaccactaatctacgtatgtatttgtctagtatggacatttcatacaaattgaatcctacaacatgtgatcatttgtccctggcttctttaaattaacaaaattctttcaaagtttatccgtgttgtagcatgaagtacttcagccttttatgagtgaataatattccattgtatgggtatatcagattttctttattcattcatcagctgatggacatttggcttgtatctacattttagctatggtgactaatgcttctatagacatttgcccaaaagtttttgtatggacatattttttcacttcttttgagcatgtaccctagggatggaattgctggatcacatggtaattctgcatttaacatcttcagtaactgccaaactgttttctgttttgcaaagtggctctagcattttaaatcccaccagcaaaaatgtgaggggaccaatttctctatatcttcatccacagttattattgtctgccttttttgatattaatcatcctattggatgtgaagtggcacctcattgaggttttgatgtgcatttcttgatgaatgataatgagcactttttgtatgcttattggccatttatgcatttttggagtaatatttttcaaattattttcctatttaaaaattgggtgatttgtgtttttatcattattatatgacattttcatatgttcaggatacaaatcccttttgaggcatatgacatccaaatatttatccattttgtgaattatcttttcattttataaaattgtatcctttaaagtgcaaaagagttaattttgacaaagttaaatttacacatttcttttttattgttgctgaccttttgttgttatttctagtaaactatcacctaactcgaggacacaaagatttactcctatgcttcttttaaaatttttatagttttagctcttacatttaggtctatgatctattttgagttaactcttcatatggtatgaggtcaggttccaaatttattcttttggatgtgggtatctagttgtctcagcagtttatttaaaaaaaaattctttcctccactgaattgtcttagcacccatatagaaaatcaattgaccataaatgcaaagatttatttctagactctcaaatctattccattgatctatatgtatattgaaatacaaattccataggtcttgattgctgtgttgattactgcaagtttgtaacaagtattgaaattatgaagtgtgggtcctctgctttgttctttctcaagattgtttggttattctggaatcttgaaattctctacgaacttaggattaacttttcaattttggcaaaaaggccagctggggttacagtagggatcacattgaatctgctcatcaacttggggactatagatattataacaatattaagtcttctgattcattacattgggtctcatttcaaatatttaggctttcttaattttttcaacaatgtttgttgcataatggaagacttgtattgtttttcttaagtttgtttttaagtattttatttgtaatgctattttaaatggaggttttttttttagagtttccatttctctgcttgcattacccatctgcttttgtatgttgtccttttcttttccccattagaactcttagcaaattaatcatagttattttaaatttctgttctgctaattccaaaatgtgtattatatctaagtcttgttttaacgcatgctttgtctcttcaggctgtgttttttatttgtttatttgttttcttttggtgtgacttgtaattattttgttgaaagccacacacggtgtattggataataagaactgagaacattagtctttgattgagattttatgttcatttgccaagcaaatgtgtttactgtttgttgtagttatgatttcagacactaaatttttatctaatgttgtgtttgagtcttgcctgttgtctttgggttctcctagagactccttcttaaatagttcattagccttgtagttttttgttctagcctgttattatagaagagtcctattgatgtggtgataagctgccgtgagaggggaagcattttacaaacctgtgattagatctgaaccttttagtgaacatgtgtccctgagatgtgaccatcacaaataattcttggctttccaccttcctctaaggtaaaacgggttttgctagagtctaaccaacctcagacaaaggaaatacccaactccagcccactctagcctttcggctcaggtagtattatttccattgagggcagacctttcttaagaacagagcactctgggtatatttcaaaatacaacaccagaggtttttctcccatcttcactctgagacccctggtgggactcctgaaggtaaaagttatgaaagtgtgtgagggctcccgctaaagctgggacaagaggaattttaatttctcattatagtccacgctcagtctccagtagtgagtaagttcatttttaatgatttatgactgttgttgtctccaatagtggcttccgttgttccttgtaagctctatgtattcaaatgtgtctctagttttgtataatggttgtttgccctgtgacctaaattctctgatatatctaagaaaagttatctattttcaggtttttttttttttagcttctttcttgttgtgaggacaggaaatggatgacagctttcaagctttttaccttttggactgaaagttgaaagtcctcaatggaattattattattattattattattattattattattattattattattattttgagacagggtctcactttattaccccagctggagagcagtggatgtgatcttggcccactgcagcctttgcctcctgggcttaagtgattctccagcctcagcctcctgaatagctgggactacagacatgcaccaccacgcccagctaatttttgtaatttttaattttcttttcttttggtaaagatggagtttcaccatgttttccagactggtctcgaactcctgggttcaagcaattcatccacctcagcctcccacagtgctgggattacaggcataagccactgtgcccagcctggaattcttttcttaatttcattttcagattgttcattgctagtgtatagaaatatgactgatttttgtatataggcctcatatcgtgcaatcatactgaacttttaaattcgttccagtagggtatgtgtgggtgtgcatttgtgtgttttggtatttttgcaagataatatcatcttcaaatagagatggttttactttttcattttcaatcttgtcttttatttctttcttaactgattgtcctagctagaacctatactgcaatgttgaatataagaagcaagaacaggtatgttgtctgttttttattttagggggaaagcgctctatcttgcatcattcattataatggtgttggtttttcataaacgctccttatgagtgtgtgaaagttcttttttattcctagttttctgacagtctttcttatgaaagaatgtgagactttttgccaaatgctttttctactatcatggagattataagttatttatatttgtcctttagtctattgatatgatgtattacatcgattaatttttggatattaagacaaccataaatttatacaataagtaaaaaatgtttatgttgtacaatcctagttatatgttgctagatttggtttcttactattttgttgagttgtattttgtatgtctatgttcagaaggaatattggttcgtagctttgtgttcatgtttgttttgcttttccttgtgaggtctttcttgcttggttatgtatcagaataacactggtctcactttgagtcaataagtgattcttcctcttcctttattttttggaagatttacaaaggactggtattaattcatctttaaacatttggtagattttatcagtgatgtcatctgggcttggtcttttattgtaggaggttttaaaattactaaactgattttatttatttgctatatatattcagatattttatttcttcttaagtcagattttatagtttgtacccttttaagaatttgtccatttcattaagattatttaatttgctaacaacagttgttcatagcattccttattcttcttattttcctctaagtttggaagtgatatctcctctttcatttctggctagcaatttgaacttctgtattcatggttagtctagttaaaaatttttcaatttggtcgatctttttaatgagctaaagttttgttttgttgagtttctctatatttttagttctctactattttttccaatctaatctttattattttcttttcttctgcttatttagtttgctcttatttctccactttcttaaggtatatgtttaggttttgatttgagatatttcttcttttttaatataggcatttgtgcctattaatactttactaagcacagcaatagctgaatttcataattgttggtacgttgttttttctgttaattgatctgaaatgatttcctaattccccttgtgaatttttttcctttgactcctttgttatttaacagtgtgggttttgtttgttgtttgtttgttttttacttacatatatttgtgaatttcctaaatgtcctttagttaatgatttctaaaatttcatttcattgtgttcagaaaatatactttgtatgatttcaatatttttaaatgcataaatgtttgatttatgtcctaatatgcaatctatcctggataatgttctgtgtgaactggaaaataatgtttgatgtttttaggtggagtgttttatagatgtctgtttaagtctggatagtttctagttttgttcaagtcctctatttctgtattgatcttcctcttagttgttttattcattattgaaagaaggtgatcaaaatatccaactattagggctgaattgtctatttctcccttcaattctatcattttcccacatatatttcagtctatgttgttaggtgtatatatgtttatattaataattaacgtatattactgatacattaaaaatttatcattataaatttcatccttttcctgagtaataatatttgtcttaaagtctctttcgcctgatagtatgttttgagttatttgcttagtttttgtccaggggattgcaatttacatgttaatttataacaatctaattggattagtagcaaattaatgtcaaagcttaaactcctctttgttctattattgacatacaaattcattttttacattataagtcaatcaacacagttttatccttattgcttgatacagttgtttttaaatcagataggaaaagaaaatccttacaaaacaagtatatttatattatctgttatatttacctatgtactttaactagtgcttttatttcttcttgtggatttgacttcctgtccagtattccccctttttatttaggttgtaattttttcttaacatttgaatgataaaatgaataaatatagactttttagttggtagtctttttcttttggtgctttgaatatgtcatcccattgccttctggactccatggtttctaatgaatagttagctgttcatcttattgaagactccttgtgtactgtaaattttgtgtttttttctctttgcattcagtctttgacctttgacagtttgactatgatgtatttgtgtgtgaatttctttgaatttatccaaatcagagttttttgaacttccaaaaatgtagattagaatttttcatccaatttttaaattttcagttgaaattctttaaatattttttccgctatattctctgttttctttttcttggcctctcatccatcatgcacatattagtaagcttcatagtgtcccgtacgtctctgagtttctgttcatttttctttatttgtttttctttctattctcagactggataataatcaatggatctatctttaagttcaccggttcattattctgacagttgaaatctgctgccaacaccttcttgtgaatttttatttcaataattgtactgtttttgaccaaacttcaatttagtactttttttgttgttgttaccatgtcattctgctgaatctatttagtacttttttatagttgctaatcctttattaataatctcagtttggagaaatcagtcccagactttgctttatttctttggatgtggtttcttttacttctttaaacatatttataataggtcattcaatgtctttttctagtaagtccatcatctagtccttctcagaaacaattttagttgactatttttccacatatgtttaggccatactttcttgtctcattgagtaccagtttttttgttttttgtttttttttgagatggagtctcgctctgtcacccaggctggagtgcagtggcgccatctcggctcactgtaagctctgcctcctgggttcacgccattctcctgcctcagcctcccacatagctgggactacaggcacccaccaccatgcctggctaattttttctatttttagtagagatggggtttcaccatgttagccaggatggtctcgatctcctgacctcatgatccacctgccttggccacccaaagttctgggattacaagtgtgagccaccacgcccgaccattgactaccaatttttaactgcacattttaaataaaataatatgccaacattgtaaatcaaatacccctccccttttgcttttgttatttctacttcttggttttgtttttgttgttgtttgcttttagtttctttcatggactaattttgtatagtttgtgtttttggtcatgagtaactactaaagtatttactgggatggtttggtgtcagctaatggttggaatattgatttccttcaatcacttcaatcaatatgtttccgaccatctgccaatgggctctctacttgtgctggggatgacttcaatctttggctgtttacaactctgttttaaccttaacttttatttatggaaaggctcaacaacagtcagtgtgagatgttatgacattttcaagtcttttctaggtatgcacacagacttttaatgcaactttctagatccccaggaatatgttagaccttttcaaagttccttattttcctgatatttaagggttttggtggcttgcctcttatttgcttcaactggtatcaccacatcagaaagctatgaaaaacaattgcctccaattgttttcaataaatgccctatgaatagggcttctcaatgcttgaattctgagtcagggcaagtaaatactagcctcataaaaggagcttttccatgaggaaaagccaaagagatcaactagtaacagttctataatgatgaaaatgcttgatctccaaactccttcttccctgtcctatgtatgctgggttgctgattttcacagctgttactgttttgagtttgctaatttttaagtctatggaactaaggtgagaggaatgagaatgcagttagtgaaaatgccataaagctcactgttcttgccaagatgtattcacttattttgaataaattgttctagcatttgtataagcctttacaaatgtcaagagtaataacaaagtagattttgacaattatttgtcagtgttctaatttcttttagggaggagtaggttttcaaatgtccctattccactattcggaaagtgctttcaagtctacaactgccttgataccagaaatcaagttagatttataaaaggggttaatttttggcctactcacaaatatctttgctaaattttctggaagcaatcatcaaaacattaaaaaaagataatgtcttttcttctctgtgataatcctattagcatactatgtttatcttcttgctcaaaatctgcatacatgtggagaatattcttaaaaaaatggacaatacatattattctgcaacttgagtgattttacatagaaagaaatgggcattcctccatggatataaatttacttacatatattgatctgcttatcaaacttattctttaatcactctcataattgcacaggatggatctgttatgtctccttcagaccagatattcaggtttatagcatattttttaaacacaaaaaacaaaacagcaaatagatttacatactgctgccttcattcctatagagggaggtccattagagaaaacttaatgaatcaaatgtttgtgccaatttatttaataaaaagcttctgaatttttactgttatgcatatgtgcagatattacactgaaaaaattgtatctgttcctaaaataagttatcaaatcgtgtatttgtacccattaatcaacttctcctcattctttcctcctctcaaacagtctaccttctgttttcatgagatccatttttttcagctctcacatgtgagtgagaacatgtgatatttgtctttctgtgcttggcttatttttcttaccacagtgaccttcagttccatccatgttgctgcaaatgacaaaatttcagtatttttaatggcagcatagtattccattgcatatatacaccacattttttttctgtatttcttctaaaaaaaaaaaaaaaaaaacaggatacatgtgcagatcgtgcaggtttgttacataggtatacctgtgccatggtggtttgctgcacctactggcccgtcctctaagttccctcctgtcatcccacaccctccaataggccttgttgtgtgttgttcccttctctgtgtccatgtgttctcaaggttcaactctcacttatgaatgagaatatgctgtgtttggttttctgttcctgtgttagttgctgaggatgatgatggcttctagtgtcatccgagtccctgcaaagacataatctcattcctttttatggcagtatagtgttgcatggtgtatatgtacaacatttccttatccagtctatcattgatgggcttttggttggttccatgtctttgctattgtaaatagtgcaacaataaacatatgtcttcatgtgtctgtatagtagaatgatttatattcctttggatatatacccagtaatgggattgctgggtcaaatggtatttctggttctagatcgttgaggaatcaccatactgtattccacgatggttgaaataatttacatttccacaaacagtgtaaaagcgttcctatttcctcacagccttaccagcatctatggtttcctgacattttaataatcgccatttttgactggtgtgagatggtatctcattgtggttttgatttgcatttccctgatgatcagtgatattgagctttttttcatatgttcgatggccacgtagatgtcttcttttgagaagtgtctgttcatatcctttccccatgttttgatggggttgtttgtttttttcttgtaaatatgtttaagttccttgtaaattctggatattagacctttctcagatgggtagattgcaaaagtgttctcccattctgtagattgcctgttcactctgatgataatttcttttgctgtgcagaagctttttagttaattagatcccatttgtcaattttggctcttgttgcaattgcttttggcatttttgtcatgtcaatgtcctgaatggcattgccaggttttcttctagggtttttaaggttttaggttttacatttaagtatttaatccatcttcaattaatttttgtgtaaggtgtgaggaagaggtccagtttcagttttctgcatatggctagcaagttttcccagcaccatttactgaataggagatcctttccccattgctggtttttgtcaaatttgttgaagatcagatggttgtagatgtgtgatgttatttctgaggtctctgttctacttcataggtctatatgtctgttttggtaccagtaccttgctgttttggttgctgtagtcttgtagtatagtttgaagtcagatagcatgatgcctccaggtttgttctttttgcttaggattgtcttggctatacagggtcttctttgattccatatgaaatttaacctagttttttctaattctgtgaagaatgtcaatggtagtttgatgggaataacattgaatctataaattgctttggggagtttggccattttcacggtattgattcttcctatccatgaggatggaatgttttttccatttgtttgtgtcctctcatttccttgagcagtgctttgtagtcctccttgaggaggtccttcacatcccatgttagctgtattgctatatattttattctctttttagagattgtgaatgggaattcattcatgatttggctttctgcttgcctattgttggggtagaggaatgcttgtgatttttgcacattgattttgtatcctgagactttgctgaagttgcttatcagttcaagaagtttttgagctgagatgatggggtttcctaaatacaaaatcatgttgtccgcaaacagggacaacttgacttcctctgttcctattcgaatactctttatttctttctcttgcctgatttccctggccagaacttccaatactatgttgaataggagtggtgagactgggcatccttgtcttgcaccagtttttgaagggtacttccagcttttgctcattcaatatgatattggctgtgggcttgtcataaatagcttttattattttgagatatgttccatcaatacctggtttattgagagtttttaatatgcagggatgttgaattttatcagaggctttttctgcatctattgaaataatcatggtttttgtcattggttctgtttatgtgatggattgtgtttattgatttgtgtatgttgaaccagctttgtgtcccagaggtgaagctgacttgatcgtggtggataagttgtttgatgttctgctggtttccgtttcccatattttattgagaatttttgcactgatgttcatcagggatattggcctgaagttttctttttttgttatgtgtcttcccggttttggtatcaggatgatgctggcttcataaaatgagttagggaggagtctctccttttcaattgtttttaaaagtttcagaagtaatggtaccagctcctctttgtatttatggtagaattcacctgtgaatctgtctggtcctaggctttttttcgttggtaggctattcattactgcctctgtttcagagcttgttattggtttattcaggaatttgacttcttcctggtttaatcttggtagggtgtatgcatccaggaatttatccatttcttctagattttctagtttatttgcatagaggtgtttacagcattctctgatggtagcctgtatttctgtggggtcagtggtggtatcccctttatcattttttattgtgtctgtctgatgcttctctcttcttcttctttattagtctagctggcagtccatccattttgttaagttttttcagaaaacctgctcctggactcattgattttttggagggctttttgtgtctttatctccttcagttcttctctgatcttagttattccttgtcttctgctggcttttggattagtttgctcttgcctctctagatttttgaattctgatgttaagttgtcgatatgagatcttcctagctttctaatatgggcatttactgctatatatttccctcttaacactgctttaactgtgtcccagagattctggtatgttgtctctttgttctcattggtttcaaagaacttcttgatttctgccttaatttcattatttacccaggagtcattcaggagcaggatattcaatttccatgaaattgtgtggttttgagtgagtttcttttcttttcttttttttttttttttttttgagatggagtctcactctgtcacccagactggagtgcagtggcacaattggttttgagtgagtttcttaatcctgagttctaatttgattgcactgtggtctgagagacttatgatttccattcttttgcatttgctgaggagtgttttacttccaattatgtggtcgattttagaataagtgccatgtggcactgagaagaatatatattctgttgatttggggtagagagttctgtagacatctactaggtccacttgatccagagctgagttcaagtcatgaatatccttgttaattttctgtctcattgatccatctaatactgacattggggtgttaaagtctcccactagtattgtgtgggagtctaggtctctttgtaggtgtctaagaacttgttttatgaatctgggtgctcctgtattgggtacatacatatttagaacagttagctcttctcattgaattattccctataccatgacataatgcccttctctgtcttttttatctttgttggctgaaagtgttttgtcagaggctaggattgcaactcctgcttttttttgctttccatttgcttggtaaattttcctctatccctttattttgagcctgtgtgtgcctttgcatgtaaggtgggtcttctgaaaacagtacaccaatgggtcttgactccttatccaatttgctggtctgtgtcttttaagttttggcatttagcccatttatatttaaggttagtactgttatgtgtgaatttgatcctgtcatcatgctgctatttggttattttgcacactagtagatgcagtttctccataatgtcattggtttttacattttggtgtgtttttgcagtggctggtaccagtttttcctttctgtatttagtgcttctttcaggaacccctgcagggcagtcctggtggtaacaaaatccctcaggatttgcttgtctggaaaggattttatttctccttcgcttatgaagcttagttttgctggatatgaaattctgggttgaaaattattttctttaagagtgctaaatattggcccccaatctcttctggcttatagagtttctgctgagaggttcactgttagtctgatgggcttccctttgtagatgatctggcctttccctctggctgcccttaacagtttttccttcattttaaccttggagaatctgacgattatgtgtcttggggttgatcttctcatagagtatcttagtggtgttctctgtatttcctgaattttcatgttggcctgtctttctaggttggggaagttctcttgaataatatcccaaagtgtgttttccagtttgtttccattctcccttctccttctggtactccaatcaatcataggtttggtcttttcacatagtcccatatttcttggaggcttttttcattcctttccattcttttttctctattcttgtctgcatgtcttatttcagtaaggtggtcttcaaactcttatatcctttcttctgcttggtcgatttggctgttgatacttatgtatgcttcatgaagttcttgtgctgtgtttttcggcttcatcaggtcatttatgttcctctctaaacaggttattctagttagcaattcctctaaccttttatgaagtttcttagcttctttgcattgtgttagaacatgctgctttagctcatcatagttttttactacccatcttctaaagcctacttctgtcaattcatccatctgattctctgttcacttctgtgcccttgatggagagatgttgcgatcatttggaggagagacactttggccttttgggtttttggcatttatacattgattctttctcatcttcgtgaatttgtctacttttggtctttgaggttgctgatccttggatggggtttttgtgggggctttttgttgttgttgttgatgatgctattgttgttgctttcttctggtttgttgttctttcagtagtcaggtccctcttctatagggctgctgcagtttgctgggggctcacttcaggctctattcagctgatttgctcccgtgcctggagacgtcactgaaggagcctggtgaacagcaaagatgggtaccttttccttcctctgggacctctgacctcgaggggcaccaacctgatgccagtaggatcactcctgaatagggtgtccgacaaaccctgttggagggtctcacccagttgggtaggatggggaacaggacccattttacaaaacactttgtcctttggtggagagagtgtgcttcactggggggaaacccactcttctgggctgcccagattcctcagaactaccaggaggtgaggctaagtctgctgctttgcagagactgtggccattcctccctttaggggctcaggcccagggagatccaaaacctgtccctgagcctctggctggagttattggaggtcctgcaaggaagcccagcccactgaggaaggatgggtcagggttaggcctgaagaggccctctggccacagactgccacagccagtgtgttgggctgtggggacaagtcttgggaccaaaccttccagcctttctggctccagcaggtgaaaagtgcagcctggagctgtagaaatgggtgctgcccttcccccacccagggagcttagtgtgttaggcagttgcaagtcccagtgctggctgccccttccccaaggagcttaaaccacttagacaacaggcagctgcagttggtgctggtcacccctcaccccaggaagtcattaggattaagcagattccagctgagaggctgtaacaatctgcgctttctggggttgggatgctaggcccttggtggcatgggttcatgagtgggatcttcccttccatgggttgcacagttccgtgaaaaaagcagattgcccggctgagtagcacgctcactcaccacctcccttggctggggggagggggttcttctttcccatgtggctttcaggtgggccaccacaccacactgctcttccttctcttcatgagtaggaaatagactagccttctagacaattttgatgacagaacttggatacctttgttgctggtgatggattcacatgcttattatgtttttttttttttcatatgagtctctgaatgccagtccttctagtcggccaccttggtcctgaccctaaattattactttctgtacattaacttctactatacctttgtgtttatttatgaaatgcttacttgtttcttagggcttatttgtccaattctaggtcaatatactattatttgtaatgttttaaagtcaagaaagagtgtttctcatctttttctccagcatttttttagttcttagatatctgttctaccatatcacaccaaagtcatttgctgggtttttgtaaaatcaagattttgtttgaaattgtattaaatgcatatattagttgtgaaaataattcatttataaatatatgatatctcctgcatgagcacaggatattctctgtttgtttgtggttcttttatgtaattttcaataaattttatactttaaaacaaattatgaccttcaactattttattaaatgtgtctttctttcttcttttgagagggggacaatgatgataagcaaaaattgcccccatatgtataacttacatgttttattaaattaccttaggattttttaactctttagtaatttctagggtttttcaaagtgtatcatcataatatctgtagagtttacttttatgtttcttatggaaaattgatatttattacttaatttacatatcctattacattagttaaatcattaaagcaattctgagtaattgtgaatgggaagtcctgatttctattttactttttaaaattaattaattaattagttatatatttaatgttgtgttcttggaataaaattaatttggtcatggtgttttattcttgtaatacactactggattcactttgctagtatttcactttcaattttatatccatgtataaaagtagtatgtatatcatgtttttatggtattatgtttattagctttagctattgataggttttattgttgttactttagctaataatatgttttgttgttgctttgttttgttttaggtttcataaaataagttttagaacattgtacgttattcagctgtttaatattattgatgtaaaataggtataatctcttatattaaggtaagtagagcatatctggaaagccatgtgggcattaggacattttctaatggcagattatgtttcccatcttttctatgatcactggactctacaggttctctatattttggtatttaatttgagaacatgattttctgttgaaaatcatcctttctctagatttgtattattttcattaccaaatttgcccatattttttgaaatttttgtaaatatctcctctgtgtacatacttacatctcatttattatatataatgtacatttttacttctctcatttaaaaaaaaaatcctttctactagtttgcctgtttgattttttttttttttgaacagccttcttttagttttatttatatgtatgctatacttttgggctttttgcttcattaatgatagttttttacttctttaattctccatcctgttattttggttgattttgatgtttcctgtgtctcggaggctttgcagtgaaacttgattgttaatgtaattgagattcagaagctatgagatgtggctaatatcttatctgtaacattgcttaaacatgactttgtggaactcttgtggagatggtaactttttcctgaatgcttgaatcagctttgaactatgcaatcaatttacctgtaatccaggaggctgcaagaagataggtcccatggtaaatgattgcaattcttttatctggattcataaaaatcatctgctaaacacttaagacattatattatattagcttacattaagtactctgctttttcatattgcctcacactaattattatgctttggttgcaaatgtattttaaatcttaagagcaatccaaatggcagttttattgtttactgtggtccttgctgactatagtaaattgtttgctgactcagcttaaatttagaaaatgtgcacatattttggatttcttcccagaaatgaatgtggctataggtaatataaatacataacaaatccccttggatttagaaatttgtggaatttcctttggcattgcagattagcagttaatccttctttcttagctaggtttaaatattggagcaatttgtagactcttagaagtaatagttttatctggacactgattattttgctggaaagcaagaaatcaggtccacacgaagaataccaaggagagaaacatatgttaactttaaaaaacaaacaaaaaatgtcaatttgtatattggtattcaagtgggagcgataaaccattaatacacatataagggatttcggagaaaatgttttggtagcagatttctgtccttggcatctgtgatggagggaggatgatttgcgagtcaactgtactgcggtagaaacaacattgggtttcatgttagtacatgtagtttcaaatccggggtctgctattcactgtttccatgaatttgatagtcactttcattcggaaacttcattttcacatgcataaaaagttgtataaatatcagtactttgtacaagaggccaattcaatgactgtcctggttttgcagggaaaatgaaccggcccgcacagcgatgagagagtgctgtagtaacatgggcattggaagaggatccccgcaaatctttaagaagagggacaaaattggttcctagatggggaaaaccaagggtggtgtattaataacagatgaaaataaggaaaagaattaaattactttgaaaattctgagggaaagggaatcttcaccacatcatcagaatcacacacagcctgctgtggtgaccaatcaccagtcagatcaccaggaggctctcttactaaacgttgaggatatttgcaagttttagtccataatgcctggcatccgagtagagactcttgtcccttacaattttactttctttccagagcttgataatttagttctgatacctattattgtgggattgctgttgtactgtaggcaaatgactcacttcctcaagttcgaatttcttcatttttacagagatggtgatgatgccttgttgttagagtgagaatggtaggatataatgtgtgtttacattcactgacctggtcccttgcctagcattaattaatgattgatgcatgtgaattacctttccttctgactacttgatatgtttcattaggcattcattcaattaatagtcattgattctgactctatgctagagacactactcagtgttacacgtgaaacaagattcctagtcccagcataatggagcttgcgaatgaaagagggagatagatattaaatcagtcatgccagtaaacataattataaattgtaaggtggaatttgaaggactcatagaaagttctttggcctggttaaagacgcattcacagagaaatggcaattaactgggatctccaatgtcagtaagagttaataaggcaaaggatgggtttagtgagaaggagatccacgtggaagcataacatgggcaaagtactagcttcaagaaggcttatggaacatttgagcaaataaggaaacagcagggtggctggagttcagagaggaattgggagatggtgcagcacagtctccatgcccttctgcttctgctttacttttaaggctcagtgttacctatggaaagaaaaatagtcagagtctacacatttatcaaattcatcagccagaaatcttatcagaaacaaaaagtaaagccttcaggtgaggactattgagcaccaaagatcttatttctgtgtggatttttttttttttttttttttttttttttttagtgaaataagatacatcgaggaggcaggtgcatagaagtcacttggaagtgacttctaacaggcctgttatgccagctggtttttggtgttgtaggctgaacgtgaagttgatataattgggctcagtatgtgtctttccttagagggagacagccgctagaataataaatcagcagtggaactttcaatagatacttctggaatgtctttgacttttacatacctctcttggcatttagatttgaatctgattttcagagaagaaagggttatagatcacaatctgagtcttcaacagcatatttgtagaccttagaggagtaagaaagaaggggagagggagagaaaaaagccctgggacaacttctgtgatgttaggatccaggggatgcacttggtttttttctccattgtgatatcccacttgacacatcacgattacaaatgatgagtagcctaggacaaaaccaccagcttcggtaatttgagttatcactcatgtaataaatatttattggacacctgtattgttctagatggtaaaaaaaataaaaaataattatgtttctttcaagcacttcatagtccttttgggcgctagacatgtggacaattacaataatgcagattaacttttttaagaacacacagtttcatgcagtttgttaaattattttgaccaaatatctcatcaatccttttacaaccatttttttcatatgggacaaccaagacttcaagaactctagtaatttggcaagtacccatagtttctaagtgacacagctaggattaaatccagtttcctcttctgtacagatcatcctcctaatcactgttatatattattccaacaaaatgtgtcaatcaaagtatatgcaaaatgccaagggagcatctaggagggattatgtgattctgactgaaataactgaggaaagttttaaagaagaggcaatatctgtgctctagctcaatgctcttgatctgggccagttgtcttcaaaccctggaaactcactatgatgtgataaacacagagttcctccatagtgctttcattatgaagaaatgtaagaggtgaactggtcacctatggggataatagggaacacagccgttatcataaatactgggaaataaaaggaaagcaataatttgcacttttctatatcaaagtatcccagctaataaatgaaagaagaaatgataagactatcaacatttggcagtccttctccagcaataaattaacatgttcattctcttaaaaaaaatttgttgtttgtttgtttttgtttttgagatggagccttgctctatcgcccaggctggagtgcagtggcacaatatcagctcactgtaacctccgccttttgggttcaagttattctcctttctcagcctcctgagtagcagggattacaggttcgtgccaccacgtccagctaatttttgtatttttagtagagacggggtttcaccatgttgaccaggctggtcttgaactcctgaccttaggtgatccacccaccttggcctcccaaagtgctgggatgacaggcacaagcaaccacccccagcccaaaaaattattctaatgtgactaaagaaaagaagaagttgggataattcatgagctgcattctatacacagaatgagacaaacaattgataaataaataatatataatttaacttgtgactagtgctgcaatgaagatgcactgatagaaaatactaaggtggaggggggaaaatgaggggagggccttcttgattagagctagacaggaccaatgaaaaggcattagacatgtagagctactagaagtttccaaagcagagggaaagacaggtgtgaaagctccaaggcaaattcaggacataggaacagaaaagttttcattgaaactatattatgagaagcccataaaaaacaattggaagattgcctctattttcaggtatcttggctcattttcccttccaaatgtttacaataaagagtgctacaggtcaaatccttgactgatgttattatcagattctttgtaaaattacttaatacagaaccaacaaagatggatttgcataagcagtgatctgaatgcacgtaacatgtgaaagaataaatgctataacaggctgatcaaatatttaaggaaaataaggtttaatttagtttcaaaagccatgctacagagacagttgagatgctaattaatatcctctgtctaactccagcacacaaagcatttggaaggtctaaggttcttcttttcttaagcaatttcttcatagaggctgtccccatgccagtttttttttttttgtaccctataacttctcccagaatgacatagttaaatcccattatttgagctgccttggcagatgactcccaaactgtatgtatcccttctagatacacaccagggtggtcagcccaagtacccacaaggacataaacatttgaaggacacagtagaaaattagagtattgtggatgtcattcctcacctaaaggccttggcaattatctatttaacggatctgttttttcctgtgctggacaaataggacatagctttaagttttccttaacagcaggatgttagcatgtcacttctatcctaggttcatctagagaaggatgtaataagcatgccttcttaggggctctctgtgtctaaaatgaaattttctgattaaatgcctttctcccactgtttcccttagcttgctggttggtgtagttatccaagtactttctcccgctaaaaacttgggaaataatttggattttcctctcctctccacctgtcataccactcaaacagcaagacttactgattctataccctaaacatgtgcctgggagccaggtccttttctcctctctgttgtattccagtaaaatcactcccaaacttgtataactctgtttcactgatttgggtctttctatttcattctccagaaggccaccagcctgaatttattaaaagtctcatttcattacactgggtaaaggcttctactgagtgcagaaccagtttattcttagctttacattcaggctactttactatctggcctcaacatacctaactctaatgtgcttctttggccatcaacactcagatacttaaatggggattaatatcctttctcaaattatctgcattcctaagaccacaccctcacttgtgataccaagtgatcactatcagaggctgccattttccccaactacctcctacttatttgttcatgacccagcttaatgtcagaatatccaaggaaactcccttcacatttcaggctgataaggtcacttccctgtgctgtgaatgttctttatctgctttggcatctttctcacaggatcatgcactttgttccaaaatggaagaaactgtggactttaaactcacgcagtattggcacaaagtaggtgtttaataattatgtaaaggaatataaatcattctattataaagatacatgcacagatatgttcattgcagcactgttcacaatagcaaagacatgggatcaacccaaatgctcatcaatgatagactggataaagaaaatgtggtacatatacaccatggaatactacacagccataaaaaggaatgagatcatgtcctttacaaggagagggatagagctggaagccattatcctcagcaaactaatgcaaaaacagaaaaacaaacaccacatgttctcacttataagtgggagctgaacgatgcgaacacatggacacattggggagaacaacacagactggatcctgtcacggggagggagtacggagaggtaaagaaccaggaaaaatagccaatggatgcttggcttaattcctgggtgatgggctgatctgtgcagtaaaccaccatggtacacatttatctatgttacaaacctgcacatcctgcgcaagtactctggaacttaaacgttgaagaaaaaaaattcaaaactgcttcccgcaatgtcccctgcccccatgcctgaaaaccttgtaagattttggttctgaattggaaatcgtatttctttaagaaggcagatttcttattcctcaggaatctatatacctgctcccagaaacagtagatggtatgtcattagacagaacctcccctgagggcatccctagaatgccagaaaaatggatcaagaggagacagtaattaggagttttctaataggagaagaagaaagacaggaatctgaaacaaaacttgtttaccagggctgttgttgccactgcaaactgtgcaagaaaacaacaatgtctcaaatgctactctctaggaatggagacagtgggcagaaatggatgcttctcccaaattatggtaaatgcagagtgccaaaacgagcttctttctttctgagaatgttcttctatttgaatttaagcttataggccacggagtgcaggcaaccagcagtcggggaggccaggcacagtggcccatgcctgtagttccagcactttgggagctgaggcaggaggatctcttgagtccaggagtttcagaccagcctggacaacatagtgaggccccatccctaaaaaaattaataaataagaaaaaaaattatcattgaaagaatgagttaatgaattaatcagtgcatatatgttctccaaaatttcactcacactttaaatgttgcttttctaagtcagtatgcttcctgattttacatgtatttattcttcctacctactccttccacccccagatgcacacacacttacctatggctttcagccatttcatattagggaatttgcctcattgttgtattctatgtaacaactagcagagttgcattcctctcttaagtagtttttggtttgaaaattgcaaaagtattactgaactttggaggtgttcagaaactgtatgtcggaagagcttgaggctcctctgcatgtggtattctagtggatggggaatttttcaatgaatatacaaaatctccaaggccttctgctgtgtaaaatataaatagctgctcttgatgttcacactcattcctacacaccttcaactggtgcaagacttatcctttagagacctcctttcactagatacagttccgttacgccttttaaatgttgagtgatgacaaaataggacttattggaggggtaaatgagggatggtgacgagaacattgattttagtcccaaatagaggaagcattcaaaaattatctagtttccccaagaaatgtgcatccctaagaaatacagtgctgcggataatttccagtcagtgtctggaggatatcttcagccattagaatcataatctactattagaaacaggtattcaattttactagggaaatgtataatgtgctccacttgtgatttttctggagaggaatgtcaaatttgtattttgcctatggcagcccccacccgctttacagcatctagaaaaattgggatttaacaaggaagaaaacactagggaaaagaaatcatgtttgcactgcttaagatatggatttaaaaatatgtattttaaacaattttacttatgaagttctctgcatacatttacagagtattttctatgaaccaggaaccgagcatgtggtggatagttaggcatggtctctgcttttcaagggctcatatcttattaatatacttttgtggatgtaacagatttaatttttaatgaacataaacatagggatatcaaatttgtgttcaaaacatctaaatctcaattctctcccacaaatggctgcttctttccccagctcccctgtattagaatgctctcacctccatatcaccaaggagatttctttctggatcttgttattgataatgattttataaaaagtttttgttcaacttttattgcacttaattactgatttggtgaattcgtatacatatatattcatgtttatatattcatgcatacataattgtctataattcagcaattatgtgtatatatatatttatttatttgtataacattgactatcccatttgtaccctcaaagtaactgaaaactctattataaactccagtgcctgctctgaaagttaactgtcaagtcttagctctgcaatttctcaagagtaacataactccttctctcattcattgcatattatcttttacactgaatgaataggggaaatagcaagaaaaggagaagcactggaatgaatgcagcagccatcaggccctttattctgttcctcaagcaaagactctttctgcgagcctagggcaggtccgaaagagatggagctatctgaaccacgtggggccatttggaacaaggcttccagatgatgcagtgagctaaggtgaggcagcagtcagcttccctggtagtagaggaagttttctcagaagagatgcaagttaaacaggggtccaacaaaggaagaatgtctagtggacattttgcaaaacataaagtcagctgacagatatctggaagagcctgtgagatcttcagaagaaaggccaggttttttgttatccttgcactcatgcactggcatgaggcccagcctgaatgaaagatagaactcatttttcaagatgaaatcatctttgcatttgccttagcttgcggctggtctggcttctgagattgctgtaggtactgaggaagaaaaggaaagaattcataatcacaatcaataacagagaacgaataacttgaagtctatgatgagtcaatctgtgtatgcattcatgcattcttgcatttgtctctactaagatgaacttaaatgcccccaagagacacattcccagggactcacatcttcagcacatcaggacctcctcacatggggccacatcaagcatatgtgtggtcgcaggctgtcattccctactcaacgtctttcagggtagaaacagctccacttactccaatcatatacgtttttttgagcaacctgtctgtatcaagggcagtgtaaagagtgaagatcaaaacaataactcattcagggctgtaagaactcacagtctgatgggagagagatagcagaagactatgggtgacatgatacactcttctcctccataacaagacactagccatgggtttggaaagaagctctataaaagtggtttctgtggattttgtttgtttgtttttaagcagtatttctgcaagaggatgcatgacagagtggagtggtctgtagaaaaataagtttgagatatgcttttacttttatacatcaagttcaacatttccctctctggtaaatttttataaaatggattagcacactacaagttctcataaatcctgcagtgaagaaacctacttgttttgtttaagttaggatttaattacccccatgggcctctctttggggaatgctgctttatatcttccagacggcttccctgagttattgtgggtgcctataggcctggtgagcacagataagacctgcaatagaacccataccatcagagcacttgaggatggataaacctttggtctcattctggctaatcttctagcaagtcaagcagttaaaaaccctgaagactggccttagcagctggtcactcagcttctccttggtgggaaaactcatgctttatataataaaccaaaatctacaacttttgactgctctttttgatgttgtgttctgaagaaatctgcctacaccctcttctggagcagatttgaaagcatccctcaaatctcttgttgccaaagcttctcagaaatttgactcttcaaacccaaagccactctctagtcaaactcttctcatcctctgctcaggtggatttttaaaaaaggcactttaaatacgtttattgattgcataattagtgtggatttaacttggtcaacacaaaatcatttatcaagttcaacactgacatttttattttggtaaatcttattgaatccaacaaaaatttccatgtaatggacagcctaataaaatactcaacagttgccctgccacaactgaaggctttgttttccatagtcattctctattagtgagtgtttctctctgtttatatgttttccctagtgtttaactcaacatcatttaatcactaaattggtatcacaggtatttttctaaattaaaagccttatcatctacgttaactgcttggctactgaagagttgcttcttcctgatacaaaaaagaatagcaatataatagtaagcagttctgtccctctgtaatacctatgtgtgccagatggtggtctaggtgctgtaaacaattcaacttatacacacctcaagacaactctagaggaagatgaaattatttttcccattttataattagaaactgaaatgcagggaacttaaataactcatctagatgactcaaattagcatatctagttggagcttgaatttgaacccaagcagtcttccttcagagtccacactcgtaaggattatattatatgacttgtctcagttgaattagtacagatttgatcctagaaggcctccagtacaattgatttggctgtcaaatatttaaagaattgaagaatcacctgtgaccatgatgaatagggagaattcatgtaggtaaatattaacattagaaaatttatctgataaatgcaagaaatttagcaaaacccaggagtgatggtgtggggagcttgggtgtttgtttcccatttcacaaaacaaagcagccaaccttacattcatctcaacaagtagtttatttaacttctcagaggaagagcagcaaatgtaaataaaatcaataacagcgactgaaaaatcttaacagggaatgtatatcagctttcctctgtgtgcctctgcttgtctattttattcaagatactgaatacatgatttctcatttgggtttctgtgctgtactaggcttcagcaatatatgcatcaaacattttgaaagtctgccccaagaggcaaaaagaccatgtgaattatacattgcctcacagagtgatgatactgtagacctacttgcatgtttgtttttgaagaatttcatccaggataaaaaaagagaaatatagttgaaagggttctataggtttgacaattcaaaataaaaaaatgttatctctatggaaagtcatagtggttaagtaggattcatatctcttctatttggaatccagcatggcctcttctattgttttgtctgccagactgtgagtgtccccagatctatgatattttgcaaaagctgagttgttatcttagctgatgtctaataaccctatttatggcacagccatgttggaaataatcattagtattcttagccttgttctataaactcataatgatgtgtttcattgtttgtggtgttagccttgggctgttagacacaattctgtttacgactatgaagtcagactgtccatccagaacatgacggattatgtattcactacatctgctgaatcagctgtgtctgtgcagtgaataccacatcctcattttcagaactccatgagctttcaggtaaaaatctataagatttaccttgtaatgtatagaacacaatttatttcattttcttccgttaaatttattccttgtggtttctgttatccatagcttgtagtttgcattacaagttgaaattcctttttgtttttgctgtggtataatatccatgtgagaatcgtctttcttcatctcagatagagaaatacaaaccacccttttactcattcactgagagactgaactagcacatttttataaaactggatcaaaatgtgcttgtgatcagctgtcatcttgtggagtttccttttttttttcttgccacaattggagttctaaaccccttataataagcacatatattagatatagtcatgtgttgattcaataacctgatttcttccctcctttggctttatcacatttgtcatataactgtcaagtctccctgagtatttgcccaacatccattgagcacatggcaaggagaaaatgtggaggattttatggagatggtttgaaaggggattcccatgccttctgtccacgtttctgtggccaacagtcagtcacatgatcccacttagatgcaaggggttctatataatgtagtccctggctcaggggatgccccagagacagttctatactctaaaagaggagtatgaatccttagtagacagttttccaactgtaccactctgtgtgatcttagaagactttctgagcctgttttcttatattttaaatgaagagaacttaactaccttacagattattattattattatatgggattatatacacaaaaaacatgtgagctgaaaaatgctacacagattcattatttttataaatgatatgagtaaaatttatttatttatcttaccttaacctagagaattagaagagcgctcaggagctaggccgtattatgagtaaattgtctttgtcttcataattgtactttttcttcagagcttcttttgtgtctttatgggatgtgccaacagagcttatgaagtcaaatcttacagataagaaggaagagtctgggaaaaccaggatgattgattaccctatctacaaaccgattttgaccatttccagggtttgttgtctgtaaccattgcattaattcaatagtaaaaattatcaaccaaagacaatacctaaactaagcatcacacaaaattgtctccacaatagctttatgtagagagaaaccaatgtgcaaggtatcaatggcacctggtgtctatactatgagaatagatatagggaagatcatgcacaggttaaaagcctgatgttttgagctaaaaaaaaaaaaaaacctagtttgaacttatctgtacattaaccagttgcatagatctcggtgagttatttaacggtcttgtcttctgtttctcatttattcaacagagagaaggttaaaagcatgttgtttttattagagttgaatttgatgatgcttctaaagggttagctgcaggggaggtccactgtggggatttagccacatgcttttcatgtgtcatttttacatgtcacagaaatgctatggatatataaagttccacagtgagatagtcataaaattggaactggaactcaggactgtctgaatccaaagctctctttcataatcatattttgttccctttctgggcatggcattgtgcctggcctatggcaattgctcagtaaatcacagcagttattgttctctttcatatctgtgcccagatcaattgccagatggaagtgggtattttgttctttagtcatctatatattagacttgagcattcctcacagtgctagtggagccacaactgccccacaccctctgagatatggctctcccagaaccttcatagacaaggcataaagttgtttgctatgtactttatctgtattaacaattttacctatttgtaatgggtttgtttttctaagaagtttgaactatgagtactcccctttctaaaactggttatgaggaagaatagaacaggatataaaagaatatcttagaaacaaagaatggagaatatatgctacactcgtgttcaaacagttaaaaaaaataaaaaaatgccaaaataacttacaaaatagatcaaggagacaaaacaaaaagcccgaagtgtaaaatataatgtattattaagctagtatttacaatgaatgaggagaagatcaattacttcatatatactgcacaaccattcagataaaaaaagttagttcttcttttcatctcaaaacactcaggaaagcacccaatttcagatggaccaaacatttaaatgtttaaagtaaaactacaaaagaagcagaaaacacaggtgatatctctttgatttcagggagggaaaaagctattcaaagcaaacaaaaagttaacaatgaaatcaactatagaggcaaattgtatatttgggaagttaactgctaaaggaaatctgtacatcaaaaagcatattaaactaaattgagaggcaaatattaacctgaggaaaacatttgcaacgtactctcattgagttttcacaatattcctgtgaggtagataataatatctccatttataatgaggaaattgacagcacagacactttaagtaatttagtaatttgcccaaggtcattcagctaatgagtggagggactggaatttgaaccctcaaaaactgaactccaagcactctttacctcacacgtggctccctcgagtaagaaaacagctctagagcccagggccatgattttgtttgtttgtcccataataagcagccatttactttcagataatatatagtcatacattatttaatgatggaatatgttcttagtaacgcatcattaaatgattgtgttgtgcaaacgtcatagtgtgtacttaagcaaacatacatggtatagcctacttgcaaacctaggctatattgtatggcctgctgttcttaggacacaatcttgttactgtactgaatactataggcaattgtgacacaatggtaagtattactgtatctgaacatgtgtaaacataggaaaggaacagtaaacatataggacaaaaggtgaaaatggtaccattgtacagggcacttacatagagcttgaaggcctggaagttgctgtaggtgagtcagtgagtgagtgatgagtgaatgtgaaggcctgtttactgtacactactatggacttcataaacactgggcacttagattacactaaacttttttttttttttttttgagacggagtctcactctgtcgcccaggctggagtgcagtggcgcgatctcggctcactgcaagctccgcctcccgggttcacgccattctcctgcctcagcctcccgagtagctgggattacaggtgcccaccaccatgcccggctaattttgtttttgtatttttagtagagatggggtttcacctcgttagccaggatggtctctatctcctgacctcttgatccgcccacttctgcctcccaaagtgctgggagtacaggcgtgagccacggcacctggctagattacactaaacttattttttaaattttatctattcaataataaattaaccttagcttactgtcacattttacatttaaacttttaaattgtttcactttttgcctcttgtaatagcacttagtttaaaacacaaacacattatacagctgcccaaaaatatctgtttttatatctttattcttaagctttttactatttaaaatatttttctgtcacttttttttttttttttttttggtagagagagggcttcactttgctgcccaggatagagtgcagtggtgtgatcatggctcactcccacctcaaactccttggcttaagtgatcctcctctggctcctgagtagataggactaaaagtatgtgctacaacaactggctaatttttttttattttttaacttattattattgttattatttggtagagaaagggtctccctgtgttgcccaggctggtatcgaactcctaagctcaagcaatcctcccttcttggcatcccaaattgctgggattacaggtgtcttttactttttaaaactttttgttagaaagtaagacaaaaacacacacactagtctaggcctactcagggtcagaatcatcaatgcatcactaggtaatagaaatttttcagctccattgtaatcttatgggaccaccatcatatatgccagttcctttttcactgaaatgttattatatggtgcatgactgtaattttgggatttctactctgattttttctaactagagtaaaagaaagttcaatatttaatacatagaaacaaaattgtgacattaaaaaaacaaataaaacaactccctagaaatatagagctgccattagaaacgctgcagcaagcctcattgtctcctgagtaccgggcctgacactcggcctgccccaggtctggccatgtctaagtgctgaggaaggaagcctttctctagagttttggtccacgccagcatccttttgcagttctcctctgtagcctgcattttcaggatgcttccatactacggaatgtattatttcctctccttggaatgcctgcgatcatcataggtatctaggaaaccatttttcaaagtgctagacagtattaggatatctttgaagtcaccctagagctacgtaatcattcctaataataaaataaaaacttccatgcatctgtgatgccactcacactagataataattttatgttcatttgccttattcctctattaagctggtctattattaagcctccaatttgtctgttagaccaatgatgcccaacctttttggcaccagggaccagttttgtggaagacaatttttttccacagacaggtggtaggggaatagggggaatacggtttcaggatgaaactgttccacctcaaatcatcaggtattagattctcataaggaacacatagcctagatccctcacatgtgcagttcacaatagggttcgcgctcctttgagaatctgatgctgttgctgatctgacaggaggtggagctcaggtggtaatgctcgcttacccacctctcacctcctgctctgtggcctggttcctaacaggccatggaccagcagcagtccatggcctggagattggggacccctgtgttagacaatctctgtgtctcctgaatccagcatagctaggaacataggaggagctgcatgatacctggtgagctgaaccaaactccacggtgaaacaacagtgctctgtgtttattctccaatgtgttcatttgagttccatatcataattcagcacacactgggagcacagaagatcccctgaccagcatcagcctgtagggacctgaatgtcagtgaaggttaccgctgccttgtggaaaaggcactgatcactggaatggaaagttcaggacaaatttggcagtgataaactcaacccctctgttctccctgggctgatttttccgctaagaaaatcttaaggagggtctagcacccactgtggggttaccatttttaaagagcttgatgcacgtcaaaaagagcatgtaatttgggtttgaaagaaaggaagacaagaaaggcacagaccgtggtgtgtgtgtttgggtgggtggggtgtgctggaagacagggcagtctgccactgggcctcaggccctgagagcctgggagagtccactgtgtttctccaggatcttccctgactcagttccagacaggctcttcacaaagactcctcagttcatcacatgattcccaacccaaccaggggacagctgtccatgcttgtgctgatggtctagctggacaaagaaaatgggtgaaccagggtatataagttccttggaggactgagagatgtagaaactcttctaagaagagtgtttccctctttggctttgtaatcttattgcattatctttattatcaatgacaaacagagcatccactctgttccagacattttcagaggtgccagggtacaaagatgaactccatcctgaggaactggtcacatctgtctatagggaattcagtctatttgtgtgccagaagagcataaagacactgacaaaaagaaaagtcattaaggggccggcttctggaagagagatgtcactggagaatgaagtagaaaaaggctggagaaactggaaccaaaggcaacagggaccaagacctcgctctgtctctcaagaaggacacaaagaacagtgattatagtgtacaccttggagtaagatagacctgggtttaagtccctactgtgatatttctaaattccaaagcctacacccaacctcatgcagcatcagttttctaatctgaaaaagggaagaaagaatatgtatcatcgttgggttaaaagagttgaatactcacataaagcatgctcacatagtgtactcacaggctcacctgaggtagcattccccatgcctcagtgacttgtgggtagaaatgaaggcttactaatattcatgctcagaattttcagctgcattgcctccactggaggaaacagaaggtcatcagcctcctgcattgagtctctccattcactggcagtttctcttagattgatacagtctgcttgccacactgtagccagagcagtttgctccatcaccatggcagggctgctaccaaataggccttcttgtccatactcctgtaccatacctttaggtcactggggccactgtagaatcaaagcactttgtttagttcttggcatgctctattacctgcatactaccgtgagccacatcttccatcaccctgtttggttctcaccattctgccatgtctgtgagcctttaccttgcattgctgtgcattgctgtaggctgagggccctgcacctacttcaggtttctctacagagttgcactggtttctaattgttgctgttactaccaccattgttagtgttatcagcagacttttttgactgatcggattggattgtaagcaagtgcaagtatatgtattcattcattcaaaaaccacccactgagcaactattgcatgttaaatattatttcagacaaggaggatgcaatagtgagcacagctgacccaatccctgacctcattcagaagtttatagtctagaaacatatcttctctcccatctttctgccggagaaaagaaaaacagtgctgctctgtcctgtgttgaattatttctcaacatctctgcatcatcctttaaatgtagtctgtgctcctcccgtctgagccctccaacagcatccacttgatcccagagaaaggaagtaatattcacctaaaaataacaagcatatcaacctcagcttctgccagccatgattccctgggaataccatttctttcaggagctggaacacagaaaatatcagcagaagttaccccaaattgttgagcccccttggttccagtcagaatatttttcaagaaaaaagataattctacttcatttgctcattgctctggttgtcaggagtatgatacggaatacaaaagacaaagaatcagtttggaaactgctagaggaattgagtaatggcaaggtcatgattctctttattttgatagctggtggggaatttgcttcttgcctctccctaactggagtgaggattgcatctttctccgctttttgctgcctacacaatctcactttctttacaagcccgttccattacattctctttctccatccctttgccatttttcttatgtgtaaaacaggaataatagccatactgacatcaagatatgttttgaggactgagttggtacattgggttatggaaacatgtccacagtagagcgcttaagggttgtgcggctaaggctttggagtttggcttcctggcttcgttatttgctttgacttcccttaggcaaattttaacctctctttgtaaaataaagaaactgatagctacttaaaagttgtagttatgacttacaaatcatgtctacaaagcatgtagcacagtgtcccacatagtaagtagtgaatataactagctactaaatttatgatgaatattattatatctttcttttcctccctttacctcaagagtgctacttaatttgctctgttttgatctctgtctttcatgcaactctctattcatttcggtgcaggaaaaaactgagatgagaatgacataaaatctggagacagtgcaggctttctggcttctcttcttagctacacgtgcagcagggttatggcagtgcagggaatcagcagatagggtctctggctgagcaagaagttccaagggagcacagatatgacactgcagggggcctgttctcaggggtctgcagtccctgtgtgaccctgctagagccttgcaccagcagctgcagtgtgaggagcacctccccaagaagagccctctatcctcccacatgcctgctctttgagcaatagtcatctgttcaggacgtatgcattatttccttctccatttgtcatatggattgcctaatatttatctgtgctgtttttcacattactctgaaaggtttctaagttatacttctttatgtgctcttggattgctggcttacaccaccactgccaccaccatcaacaataccacgactgctaccaccgtcaacaatatcagcactaccgccaccatcaacaatactactgctgccaccaccatcaaaatcatcaccattaccaccatgaacaccctcacaaataccattatgatcagtatcaccaccactatcatcaacaccatcaccaccacaatcaccaccattaacaccattaccaccatcaacaccaccaccaccaccaccactgccaccaccaccatcgacaccatcacaaataccattgtgacaactatcatcattgctatcatcaacaccatcaccaccaccaccaccatcaccaccaccaccattaacaccatcaccaccagcacccaccattaccaccacttccactgtgtgtcaagcttcctctcctctgggacattttttctgtttctggctcagacttgcacatccctcctatttgctttttctgtttccacattcttatcattgcacatgtcacacccactaactgattttggattgaatcctataaaatacagctcatgtagatttatccatttgaaattgcttaaatttgaccgtttttgactgtttgcttatttcacatattcaagctggtatttatctacgcaccccattaaactgttagttacgtgagaaaacaaggagaacttttactctattttggcaacacctggcacagtgcttgatacttgatacaggtgcattgaataactgaatgaggcatatggcataagctttatagactctgaagcagtattcaaatgtaagagactgctgcagtaaaacaattgagcatataaaaatattttcatattaggccgggtgcagtggctcacacctgtaatcccagcattttgggaggctgaggtgggtggatcacctgaggtctggagttcgagaccagcctggccaacatggagaaaccccgtctctactaaaaatacaaaaattagccagacatggtggcacatgcctgtaatcccagctactcgggaggctgaggcaggacaatcgtttgaacccgggaggcggaggtggcggtgagctgagatcacaccattgcattccagcctggacaacaagagtgaaactccatctcaaaataaataaataaataaataaatctatctatctatctatcttcatattaaaaatgtgacctgtccttagaggttgatttggaaatgaagaaaagaaaagtgtgagactttgaatcatagaagttcaaatatattccagagttctcagggtaagtcaggggcagccttgggggatgagtaggtagggtcccattttcttcttctgtctctgctgctctacctttatttgtttgtatattaatgatccaaatatacatatacacatatatatatatatttatattactcataagaaatttaaaaattctgcaatagatgtcatggagccaataaaggacttcaggcagggaaatgtcctgttgagattagtaattttgggatgtaatttttgtttggggcaggagcatcagtgatggggtgaagagattgaagctggaggcccaagggtcagtgaggagatgggagctgagaagaggagatgggctggacaggaagctaggaatattcatctcactggaggatgcggggactgagaggggaagtctgccttgatcccaagattgggggtgattagggggctatgtggatagcagtgccattctcagagacaggtgctgtaagaatagttttggggagaaagatagtaaatctgatttgagtttattgagtgggagatatgactatacaagtctaaaattgatcttgcaaagtgggtaggctgataactgtcttttttattttttcctattttgttgatgtgaaaactgtggctcacagaggttgcttgaatgaccaaaatagaaaagagccagggagatatagggctggtcttgaacccaagatgactacattctttaatctcttcattatctgtccacctactagaaagtcatattggaagtgatggatgccagctccccaggcgttcctggcctccttaggattggatgtatccagaaactgactagtgagcagcgcttttaatattttaattaatcattaactggcttgccctctgagcactttttgctcctgctttgaatttttagacagatggcaggcggttatttcctcagctttgtcatctttcacatggcagatgaaatatcaagcacagacttggagaaggatcataattcattataattagtcttctttgatcatttgtcctttgtcctaagtacagtagcaacatttaattgtggctgaagcattagtcaagagcagtgagcaaaatgctctctctctctctgtcttctctcaatatatgcctgagggcaccactgatgttgggaaaccatattctcagttggctttttaaatagctatacagcagcaagtggaaggggcgttgtatttagaagccatgacatgaatatggcctattttccttgatcatgttagtattgttaattaacatactgaccatttagtactgttgtgaggatttaggaaggaaaggagctaactaacattaactgatggcctcctctgtgcttgataatttactgatatgctctcactacctcttcagaacatgtcaaggctggataactgggcaaagtcatgcagctaccacatggcagagaaccaacccctcaactgcctgaatccagaacctatgcatttgtacaagcttgtttatctgcactctcttgtagtgtatttacttaacaagccaagttagattgtaatcgaaagcaggtgctgtcatatcactgcatgaatcttgaaaagcatggctctgagaggtgacactgagagtggcagttgctggataatgtgttgttacaaattaacttcttgccctgccaattaaaaagcactttattgaataaagtaatgatgctcttttatgcctgttgtgtgatttagattttagtagtcaatataattgtatgacttagctttcagtctttacactcacttacccaagtcttatgaatcaggtggggaaatgaaattagttccattttacagatcagagaattgaggctcagttggtgccactgctattgaaggtcagctagcttttaaataatcagactgtagacatgtagattcatgtggcctctcctaaataagatccaagcagtagcaaaaatatgaagacttaggctcaggaaaattttttcttagaagctgacattcagctccaagtcatatggttagggtttgcttctttccacttttcaatttctgacactaagtgataattatagagactgagaagcaccgagtgcatttgctgaagctaattgactcgatggggggaaggctgattgtgcagcggaatccaaactaccaattaaagaagaaggaaatcacatgcacatgatatcttggatatttatatcttggggaactaaaagagccagccttccttgccaccgtggagacagtctgagagtcaaagtgcccggccctggggtggtcagcttgaggcctgggtttggccaagaccgcagccagcagcaccctggtcagcagcttctcagcccctaatgagtgctctggaggctgtgcttctaggctaaaatgggaaatcttggcaaaggaagagattagattcaatgcacaatgagagaggaaatcaggcaaataggagctgcatcaatcaattaattatcagaaaaagggggctcagaatacactaataatgctaacttgtgtacagtgctttggagtttacagagtatatggctctctcaacagcagccacttaagaagcaggagtgtttcccccagcttccagcaggcaagtgcatgccctgcttcccaaatctcctgggcaagaggagctaggccaggaatgcaggcttctgacttatggtcatagctgccgagggctgcctgcattgatgggtcctgggggtggtagtagggagtagacttggtgtggtttgtagctgattctcccaggaactggtttttgtttgtttgtttctaaattctatcttactgaagagcatccctacagtggcacaccagagtggctgcaaggctaacgataatggggctattaactaaataacggtgctggcacaaagaaacagccatgctaggatcttaattaggctctggctgaagcagagatggagcacatttgcaagagatttctggttgactaatctggtgtcaaattaagagtgttctctctgggttgtctcaagtcagtcaccgtatgacttaaaaagttgtctaaacgaagaattccaagtgggccaatttctcaggagaagagaggacttgcttccccaagagctagctccctggaatagattagcaccaggatccctttgtcttcgttgactaacagtttaactttacaggcttctcagctgggagtccactgtttctgtcccactaataagggctgaagtctgtccggctgtgtacctgggttactagagctgaaaagcacttggcagtcctggatgggctgtttatgagtagttcttctatctgcagcagcagttaaatggttctgggaaatgaatcaggatcaaaggggagcttgaggccagggcccagaacctgggctcttagggggtggggggcagcagaacagaacaaagtagtagggaaagcatgatgtcacacggaccttgtatctcacgtgacctctgctcttcccactggttgtggggtagagccatcatgttaattctgctgggcctttttcaatacctttaaaatgggcttattcatttctatgtcatgtaagagtcatgaagtttggatgaggttagagtttatgactctagccagggacacagtaaatactcagggaacagtcgttgcttctggatctatccagcttctttagaggcctgatgtctctatcaggatgtgccttgtgattgcccaggcactcatgcctgtttagattgaggtcccaaccctcctgacttcattggctctgcccagtggtgcactcccttgacctcctctattcttgccgtcacttccaggcacctgtgtctggcttttctcttcagtgaataattcaaatcctatcatcctctgactattcctcctcttctcctccaacctctgtctcttctacttggtacagcaactctgactgcccttggaataacaccctccccagctcaaccactgcctgccagagtcatgaactctagaagcagattccaccaggctttcttccccaaaaagaatatgcatcacaagaggcacttgagtagggagaggggatctctgaagcaatgccctaacccccttctttggctttttgatggattatgttgggtggaaatcaacttcaacatccatcttctagtggaagctgactcctctgattgccactagggagataggggcttaatgaaacagaattattggactaggaaagtataggccttgaaatcgacctgcttctaaaggtaaacaggtaggcagttcaggccaggaagctggaagaagactggtaaataagcaggatgctgcctgaagaacccatgcagaaaggtgatgaatggagatccagcaggcaggtggggtcagcgactctggaaataaggacacagcattaacggtcaggccagtacccaagaaattagacagacatgtgctgctgagaatagggtgaatggaagcagagtctagatcctcaggttaaataaacgatggtcacaggaggaacatggcatagcctggaaggaggggcacacacgatgaggaggtgaggacaggcaaggggaaggggaaggggtattatgctgggtttcaggatttggggccctagtaccctgaccaaaaaaaaaaaaaaacaaaacatattggccatacatttttaagcaggcgaaggcgggtggacagggatccacaaagagcttcaaggatgtgcaagctggtaattccacagactgactttgcagagattctatcaacttatttaaataggggaccgttattgaatttttacctgttccccagcagatagaatcaaatgagacagcatgtgaaggagccctgtaaacagtcaagcactgcactttattgacaagtttatcctttatagaactgctggtgttctgtgagcccattattgtactcactaaatattagctactcaaacatttgctattatgatgtggcagggaaaattgtgaagtattaatttacatttatgcatttcctcttgcccttatccaaaaaggtagcaggctctgggcttcctggcctgcaatacacttctgttcctcattttatctcttccacgctgccaaactcatggtgaatatttaagaggcagaggccctctcagggaaacaagtaaaaatgggatatgttttcctttgatctgaagacaatttgcagtcctggaaaaggaaggaaggattttgaatcctgctgaagagggaacttgtgctctattccctggtagcagaccaggaaggtggcctgctttcagagagagaagactgtgaatccacaccaaggggccccaggaccctaagctgctggacaggaagggaacaagaggacaggaatagtagggcactcactggtgacttgtgacgatggatgtcctgtgactgatgagctaaggcattcatgctaccaaacagctctgggccttctaccactctgagacttaggggcatggtagaggaagggatttaagctcagtcataagtatatttgattttctttcctccttggtagagaaggatatatcatattaaatttaacttgattttaaggaaacgagtaatatggcctttgtgcccatattcatgttgtgtgtgtgtgtatgtgtgtgtgtgtgtattttgaaggtcatatattttgcataactgttatatgatcacatatctcctaagggaaatggaaaacatttgcccagcacctgctatatatgcccctgtttctagcacatcactaaggcaatcaatttgagacttcagaataacctatgaagtattagtgtcctctttatatagataagaaactgagttaaataatgtttaagtgattctgcactaggataggtggttagtgttagaactaggatttaaacccaggtcatgtgatcccaaagctcaacctccctccaccacatcacgctggattccccaagaaggaggaggttagcagtgatgctcctcccttgcatgagaagggtgggcgcctatggcaggaggtttaataactatgaactgtgatataaaataattctcttgaatttatatggaagtgtcagacctttagaggaagtgtcagaccttcagagggggcactgctgagaggctgaatcattgaggtggatgagattacatatgagagaccttcaatgtgacccagatctgttttattttaaaaaacagttatcactgtcctcaccaccatctccctgctgaccaccacctttttaaatctcagcattgaggagagatttctatggatacattggcattgtccaggagacaggtgacacaaaaagacctgacagatttctcctaggcagagaattatgtgaggagggtgttgaattacatctaggaatagaatagtctgctggcgctgcagctacagggaaatgcctcactgaatatcagcaggcactttagatctattgcatctaatggaatcttcagtgtgatttaaagaagtagatattctgatttgattcctgttattttggtggtcatggggaaggatggggagtgatattgagaggagagagagagagaaagaaagggaaggagggaggaagggagaaagaaaaagaatctttgtatttaaatcagtgacaatgggagaaaaaaacaaacaacattcctgatttcttgctatcattgagcataaatatcattatttaactcttatagctcagaaagataagctcccagtcagctaggttttagcttctttgtgaaatgaatgagctcccctgaagctcatcacatgcattcctaaataagtttgtaagggaactacagttattcacttggcctgttgagttcttttcattttgcttttcgaaaatggttcttaagtgaaaagacacatgtttattgcctccttcattctttccctccccttttccctcccttccttccgctttccttcaatttccccctgcttcttttcctgctatgaacacttattgaatgcttgtgtttacaaagcgttgagacaagtacaagggagatagtaatggtcagacacaaagagctcctggtgcactctgtaaagaaacccagatctgtagaaagttaaagaaggacccatggagcaagaggcatatcaaacagaacttaaaggtgagtggcacttcaggagacagagatgcctcttagtggtggtggtggtggtggtcatggtggcgtggtgttgggggaaaggttctgatgaggaatgtgcatgagaaaactgacaaagacgtacagttcagggagtgatcatggctaggccatggtggctagaataggagtgggtatgcatggcatatcagggaccaattgtgaaggtggagagccagcctctgagtacctaggagccaagctattcctctgggtacctggccttgccgaagatttctgagtacataggaagcctggcctgcatgggcatgcagacatgagctctgtgtgtctgaatgcacattagtacaagatgtttacttgatgttgcatttcagattagatggtgaaaatgaatggatattatcattattatttccttctaattacttccttagttaaggtcaaaatagagccagagatgatcattttttcccttgcatctttgaatgtgcatgctaagaaacgcaatgtagtggcaagctaatcgctttcatcccatctcacctagtcaattgtacaaaaaacttgccgtgtttctacttttccagactgtagaagagggaagtgctgggggcctctgtgtgtgctgctgtcaggtgggagccctccctctggcctctttataacctgtttctgagatgcagagctcaaatccaatgccatgtcaaggcacactgtaaaagaagggctttgggtttctgagctcccgtctaaacagatctctatttattgggattaattgatcattaatatttgcagtaaagatatctttcagtgagagtcaagaaacttggtagaaatcgctgaggccttgaagccagatagaggtagatgaaagatctgtcctcactactcatgctgtgggtaacttcacacaagtggctgaaaccctctaggcttcaattttctcctctcttgagaatgtattataaggataatatgagacggaatgtgtaaaacacattataagtactcaataaaagagaacgataattatttaacagtgttagctacagggacagaaatcatggagagttcaatagtactttgttaagactggaaagattctgcaccctcacaatagagttcgtcagaggcccatgactgcctaatggcactttgcaaagaaagctgataagctggaggcaggttccagcagtgcccagaactcagccaggttaaacagcaatgctgtgtctcagtgacaaacctcagtgtcctctggcaatggtcacatttgctgttagctccagctctggttgctgtcctgcctgggttcagctcagcaatccttttgcccactgttgtttccagaaacaagtctcagctccatttcccagaaacagtccttagttgaagtgagagcttccaaccctgcctcctcaagctcccctgccctactcagccttatcagggacctctgtttatacagctaacctgccccattccccagtctgctgtccacacaattccctggttctcccaggggcctggttctgcggctgtctttcttttttgatggtccctgcacctctctgtgcaagagctgacagagactccaggctcctctgtggtcctcttgttgctggactttttccttagttcagctaaaaacgggatccttgtcacatgaccatgaaagattaggcacacagacacttcgaagggtgagaagggcaggctttattggatgaaaaggggaaaaagggaaatagtgactctcagcaaagcaagagtcctgcaagtagacttcctacctcacagattgaaacccatttgaccaccctggaactcgagaggccaggcgcctctcccctacaaacggtccgaacttcccacggctccaccccattctcccagtgtgcaggcctgttggaggctctctggggatctctttaaacttggctgtctcactctctgttacctggttgcctgctggctgtcaacccacctgaactattgagagatcatgggacattctgaaggcatttcttaatgttcctcctctggcccagtttaaatgacatcttctctgcaaactatattacataaagcttttttattttaacctataggcttactttttctcaaagaaaaattgtaacataacttcagggaaaattaaaactgaaagaattctattcgtaatcaaggtttgcgactgggcacggtggctcatgcctgtaatcccagcactttgggagcccgaggcaggcagatcacaagttcaagacctgcctggccaacatggtgaaaccccgtctctactaaaaatacaaaaatgtggcaggcacctataatcccagctactcctgaggctgaggcaggagaatcacttgaacccaggaggcagaggttgcagtgagctgagatggtgccattgcactccagcctgggctacaagagcaagactccatctcgaaaaaaaaaaaaatcaaggtttgtatatttcttaaagtttggagccaaattataattgattcattcagcaaataaccaagcatctactgtgagggactgtgtatgagccaagtaggataaattacttaatatgagtggatggtggagataaatcatacttgaaattgaaaaaaaaaaatactagaacaaatcctgtctcttgctcctatgtaaccataatcctttaatcttcaaattaaccatggtcaaattcttaatatcttttaccacctataaaaagattggtcagtctttgaaaaattaaacagacatttgggtcccagagcctggggcattgaacacattttattcgaaataggttttgtatggatgtgtgcctattccatgtagaagcagacatagcgagatggagatacagcaaggaagccccttaaaatacactagttcaatgatgagaaatgcactttctgcaaaaacagcttcacaggtatataagtgacagttcggagtcctttgattggtgtttttgaaaagagagattgagattaagagaatttgtgctgatttccaatagctcttctaccttaaaatattttttatgacagaggctacttattacaatattttcaaatgggttatcaagcatcgccgttttatggcaattccccttcgggtatccctgtccaaataatgtgcatttctacttgactaattcatttaggaggacaacagacacctcaggggagacatttaaagtctttcttcagaaggactcccatgtgtggtaatgagagcatgttttccccttttctttcttctcttccattatctcagataacaggaattaattagtgtcctacagtcttttactttaaactccactttaagagactcatctactaagtgactttgttgttttattattttgttttgatttttcttattcttgaaaacaccagggctgcttctagaatttcttgaataagccaagccaacaataggcacaatgctgccttttctgtgggtaaatacccactcttcactaagggaaggggtgtggtgcagacattgtaggaaagtggtgctcattttccttctgagctgatgcacagtgcctgctgcagtttctaaaaacagcctgctaacataacaatataccaacttcaggaaaattagtgtgggctttctgtgaacacacccagttgttgacacactttctaaagcaatcctgtgattgtacagtcatggtgctagacagtgtgatgtctgtgcgcaccagcttgcttttctgcagtgttcactctatcaagctaaaatggagtgcctattcagaaccacgcactgagctgtgtgttttagtgggtgaagaaaggaactgctctttgccctttagaaatttagagggtgactagagttataaagtaaggaagaaataaatggattatagaccaaatgcagccagcgtcatggagaggtatagtaaatgtattaggggtgacaaaaattgtttttcagtttaaaagagtcaacagactggtgtcagcaagatttcccccatggcaacatgaaaacaaacaaacaaaccaacaaacaaacaaaaccagcaactagaaacggactaaaataactttgtagggactcggaaattggcaaaggtatacagcaaccaaataaacacccaatcatggaaaagccacattcaaaatgatggggagctttgtggcattttcacttgccattgcccctttgccttcccagtgtcgttcagcacagtatgagggagttggtggcccagtcctcagctcccttcggtgaactgaagattgcagagaactgagtttgcaacatcctaacttgtcttcaggctgcttgaggtgtcactaactcagtgtataaaagagcaaaactagatttgaccgcagtctgaaggaagccatgggaagcagtggtgatgcctcatgaaaactgcaaggagctacaaacgtgaagacccctgagacaagagattgcctgctgaggaatacaattgaacagctaaggcccagaggagaagtaggggtgtgactcttagataaaataagacatttaaaaactatcatgtatatgaagaattgggggaaaaaatgatgcattcacaggaccaggaatatacatgttcagaacagtccctcaagccttaagagaggactttaaggctttatgtcataccgatgagtgaatgccttcttctgcatggactatgtgcagagactggagaggtgtctgtgtctgttttttgcaagtactctattttctatgagagatcagagatatacaaagaaatatgaatgcatggtccattcaaaggaaaaaacaaaatccccagaaatagtctctgaagaaatataggcactgagcttactagataaagacttttaaatagctgacttaaattttctcaaggagctaaagaaaaacatgaatggatgactaaaataaatcaggaatattatatatgaacaaaatgagaatatcaacaaagagataatatattttaaaaagaagtaaacaaattatggagctaaaacatacaataacaactgaaaatttcactagaagggttcaacagcagatttgaagaaacagaagaactaatcatagaacttgaagacaagtcatttgacattattgaatctgaaaaagaaaaaggaaaaatgaatgaagaaaagtgaatggagcctcagggatgtgtgggccattaccaaggggaccaatgtatgtactacaggagtccaagaaagagaagcaggagagaaagaggaagatatcttatttaaagaaataatgactgaaaacatactaaatttaggaaagaaatgaatatacaaatacaagaagctcagtgaactccaaataggataaattcagagagagtgtacctatattaagacaaattataataaaagtattgaattcaaagacaaagaaagcatcttgaaagcagcaagagaaaagccaggtatgataattccttctaagattatcagcatatttctcttgagaaacactgcaggccagagggcagcgggatggtgtatttaatgtgccgaaagaaaaaaaaaaggaagaaaaaaaacttatcaaccaagatcttaaatccacagcctagctttatactttaaaaacctcgaaaaacagcaagaaaaagctagcagaaagaaataacaaagattggagcagatagacacaaaatagagaacagaaaaagaatagaaaaaatatatataaatgaaacaatgagttggttcattgaaattttaaataaaattgaccaacctttagctagattaactatgattgagagaaaagactcaactaaattcagaaatgaaagagggaaaaatactaacaccaattttattgaaatacaaataattataagacagtattataaacaatataaccaacaaattggataatctaggggaaatggccaaattcctaaaaacatacaacctactaagactgaatcataaagacatagaaaatctgaatggacatataattatccaagacattgcatcagtaatgaaggagctcctgagaaagaaaagcccaggaacagatggcttcatgggtgaatagaatagaaagccaagaagtaaacttttacatatatggttaaatgcttttctacaaagataccaaaaccattaaatgagaaaataacagtcttttcaaaaaattatattggaaaaattggatattcacatgcaaaaaaattaagttagacccttatcttacactataaaacaattaactgaaagtggatcaaatacttaaatgtaaatttaaaatgctaaaaatattagaagaaatacaggggaaaagcttcatgacattggatctggcaatgatcttttggaaatgacatcaaagccataagcaacagcaacaagaaacataaattgaactacatcaaaattaaaaactttcatgcattaaagaatgttatcaatagagtgaaaaggcaacccatggaatgggagaaaacatttgaaaattacacatctgataagcagttaaggtccaaaatatatagagttcctacaacttgacaattaaaaaacaacttgatttaaaaaaagagcaaatgacttgaatagacatttctccaaagaaaatatccaaatggccaataagcacatgaaaagaaattcaacatcaacaatcactagggcaaggcaaatcaaaagcatgaaaacatagtccctcacagtcatgaggatggctaatatgaaaaacaaagcaaaacagacaaaacaacaaaacaaaaaacaagttttggtgagaatgtggagaaatgacatccttgtgcactgctggtaaggatgtaaaatggtgcagccactgtggaatagtatgtcagttcctcaaaaaattaaaaataaaactactttatgatccagcaatttcacttgtaggtatatactcgaaataattgaaagcagggacttcaagagatattgatacactcatgttcatagcagcagtattcataatagccaaaggtgaagtcaatccaagagtcctttgatggatgaatacatgaacaaaatatggtatatatacacaatggaatattgttcagccttaaaaaggaagaaaattcgaacacatgctacagcatgaatgcatcttgaagacattatgctaagtaaaacaaacctgtccaaaaaggtcaaatactgaatggctctccttatatgaggtaccaaaagtaatcaaattcatagagacaaagagtggaatgttggttgccaagggatgtgtatagagggaaatggggagttattgtttgacagttacagatattcagtttgggatgatgaaaaagttctggaaatgatactgataatggtcacacaacaatgtacttaataccactgaagagtatacttaaaaatggttaaataagaaatttaacataatgtatattatactacaataaaaaatagtaaagttttttgaaaagaatcaaaataagccttatggaataaatgtcatttgacacgtgagttccgagttcatccagttaattcatccagactttcccttttggaaaggatggatgacaagtctggcactacttctgggccagggtgaacagcagaatctgagtataaaaccacatgtgaactagtgctgcagaagctgatgttcaaaaaggtccataaaatcaaaagagaggccaagtgtggggattccatatggagaaccatgaggactgatggcaaagatccccagaatgcaccaggagaataagaaggagaacaagaacctcaactgtgacctgagacatgggaataccaaatccacacaaggagttaagggaggaaatgtcaagtagggtctcacgagcagagttgggttccagaagaaagaacatgaccaacgcagtgagatgagaaataggtttattgagatacataataataataatgccaacatagaccactaagggctttaatgtatatgagcacagggacccattaactggattgtattattatcccttttgccattggtaattttcctattatgtgtccgagcaagtatttgaacccaaagacctcagagcccatgcccttgaccacttatgctatagagagagaattagctgagtataacacaaaacatgaagtcatttgaatcacattttaaagggctgaccttcagatggtggcatttactgggccttgtggaaccttgatgttttttagcaggcaagagatgagaacagaaattactctgggaagacaatttggcaacacagaaatgaaataatttgatgaatgtcaaggctgaaattagggagatcagttagggaacatagaggaataaggcataaaccgaggggacaggaatggaatgtgtggactcaaaaacctttgaggaagttgaatcaagtggatttagctactaattagctgaacagtgccaagactccgggagagtctgcaatgactctgggacatctgaaactatggtgaggccaagtgtgcaatgatgtaagcagggataaggaaaacgggactactctgtggtggttggaattaattgtcagaaatccccaatcaaatcccctctgggatttgaagaatacatttttaagatgcataattagtctgaaagtaataacatgaatcctaaaatgcttacgaatccctttactaccatggatactaagctctttaatagggcacaagaacctctgttaactgggtgagatttaggagttcagcaatcacaagacagctccagctatttgagattatgctgagtgttggcttgtgtcactcttttttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatcggaaaggtggggaaaagattgagaaatccgatggcttgtgtcactcttgaaaattactttgaagtcttttagacttatcctattatatccttttatatgccacgccagttgaaacttggaaataattaaaaacaatagacaagaacctgctaatcttttatggtattcttctatttaggaaataattgattgggcgaagtggattacatttcaatattcagacaggctccttttgttattacttttgactctatctgctttttaaattaccttgcctattttgaaagcacagtacagttttcttatgtttctctttttggtgcaagacaatgtagaaaggctcatggtgtaaaggtgaaggatatccactatccaatttaatatccttacatgactaacatttttagagaaatagtcctttgaaattaataggaggtgatgtgacagtggaaaaaaatgtaaaaatcaatcagacttgattttcaatactggtgctggcacttaagagctttgggattttggaaattgaattaaataattgatcctcaatttctttgtctgaaatataggaataaaaatacctttaactcagggttattatgaggtttggtacatacgtatatttatatgtaactatatgtatacacacagacatacacatcacacctatagacagagaggaaggggggaagagaggatatgcacgcgtgtgtagtcttggcacatagtaaaaaaactggccgggcgcggtggctcatgcctgtaatcccagcaccttgggagacagaggtgggcggatcacctgaggtcaggagttggagggaaaaaaaaaaaaacagctgggcgtggtgatgcatgcctgtaatccccagctacttgggagtctgaggcaggagaatcgcttgaacccgggaggcagaggttgcggtgagccgaggtcgcgccattgcactccagcatggacaacaagagcaaaactctgtctcaaaaaaaaaaaaaaaaaaaaaagcccggcaccggggctcatgcctgtaatcccagcacgttgggaggccgaggcgggcggatcacgaggtcaggagattgagaccatcctggctaacatggtaaaactccgtctctactaaaaacacaaaaaaattagcggggcgtggtggtgggcgcctgcagtcccagctacttggaaggctgaggcaggagaatggcgtgaacctggagcgcggagtttgcagtgagccgagatggcgccactgcactccagcctgggctacagagcgagactgcgtctcaaaaacaaaaacaaaaacaaaaacaaacaaaaaaaccttaccatttaaaaaacgtgttctgtcctgccctaagaaagaatgcctaatgtttttgaggttcatctgctatgataaatgaaagaagccaaactcgaaagattgcgtattgcaggatttcattcataagaaaggtcaaaaattcacaaatttaattaggacacaaagtagattagtggttgtctaggattgggtagtggggttgataatggcaatttacaagtataaggtttattttctttttgcagtgggaaatatcttaacattagatttgtggtaatggttgcaccactctgtaaatgtactaataatcattgaattgcacacattcaacaggtgatgtttaagctatagtaattacatcaccaaaaagtcattttaaaataaaaaggatgatatttctgtatactaagctgactatcctaagtaaaataattggtgcttatgaaaaaaagaaacattatttgtgctttggggttaaggaagtctctcctgtatttgtctttaaatatttctttttgtgtgttgaccatttttttggtaataactccccaaatcagagtggtatatgagaatcattttctcatttacattacatattggcatctattcaggtctgtttgtgttttgccagccccactctgctctgattagctctggtccacacgtattcatacagcccgtgcatggcacatgcttattctcatggcacaagagaaaactaagccaaacctattagcacttaaagcttctgcacagatataccctgtttcatagctgcttccgtgtcattggctaacgcagctcacatggtcaagcctagtgctgatggaagtaaacttgcacttctaccatggagtgaggggattatgaatatttctgaacaataatacaatgagacaatctaccagtgttggaggacgatttggctaacatcctgacttgagcttaatcctctatcagtgcttcccatcccttctactctcttactatccaaagtatatctcatcttcctcttttcccactgggatttactgtaaacccttttctcctccaccatgaaaaactctgccaaggagcttgctgtcattcccagctaccatctcatgccttccatttcttgtactgccagacttcacaattatgaccaattggtgtccttactatttctctatcatacattgtttttatttctctatcatatttaactgcgttatgacttgaaacttctcaatccattggatttactctttctaaagcctctaatggccttagttgccaaatccatgacatttcttcagccattatttattttgatggtagtcatatttgtaccgtgaactcataaagtgcagcgtgtctgatcccccttatttgccaggttccacattcttctcccccacacttccttcctgtgtgatctggtatagtcccaggttttactttctgagagtgtgactcccatattaacatgtttatttctggctttcttaagtaagaaattaaagggtcaaaatgattactctatttaattaatcattcatttacatattaacattgctaatctgtttttgaacaggatggaaacagaaaacacttctctgggaaatttaaaggtaatcttaggtttaataattctattcataaatattactgtatgtagttgaaattagttcacaaattataaattacaattctaggccgggcacgatggctcacacctttaattttagcactttgggaggccgaggcaggcggatcacttgaggtcaggagttcaaaaccagcctggctaacatggtaaaaacgcatctctactaaaaacacaaaaaagtgagccaggcatggtggtgggtgcctgtaatcttagctactttggaggctgagacaggagaactgtttgaacccgggaggcagaagttgcagtgagctgagatcacgccactgcacttcaggctgggcagtagagtgagactccatctcaaaaagaaaaaattacaattctgtagtagaaatacagtattatgtttcgaagcacagcttagctcaatgcctgtatctagtgatttttctctccatttttaaaaccaaacatatacaaataggaaatattagggattatacgtgtagaattagatgtgctctgtgaaaaaaaaaatccacatgtagaattatgcaaaatacttgggcaaatgtaaatataccacaactgtttttattaaatcactatttttagttatcatgttgtctttatgagcattgagcacacttagtagaaaggctgccacactgtgtttagccttgtcatcctggaacaagatttttcatcttgaatagtctgataccaagactgaacccatctactgcaaagacctgtgttctgggaacgcaaagaatattctgacccccttttccagtattgagctgaaatcacaaagattttgtggtatagtgataagagctgtaagatttgggtttctattcctggcactaaccttggagtacggggacttgggagaggtgtggtgtagggaaacaggcaaggtcagtgctacacagagtgtgattcttggataggcaccatcaaagggaccacggagcttggtagaaatacgcatttctaggtttcacccagacccacccagacctgctatatcagagtcttagggttgagggccagccgcctattataaccagctatcttgatgtttcaagtgcttattaaagtttaggaagcacagggatagtcatctctacttaggcaatgaggttttgttaatcttcatagaggtgcaattatgggaggaaaatggtagtgagtaggagattgtggttgataatgatgtacctacaggattacagtgtgggggcaaatgagagagagtcataaatacagagtctgagtgaaccaaaatgagccttggagggagtaaatcttactgtagacaagcatcaagtttaccaaccagcacagatcctacaatcttgcaaggatgcaagaattttcttaaatgggttaacaagtaacttcagttcaaaaaattccaacattcaaagtttctgtccaggaaaggcagggcagatgggcccaaacagatgaaaaaaagtaatttgatgtgggggatttctaggaatatatgcactccctacttgtccatgcagaaccttattcagagaccagcctggcctttgctagagaactggacttcaaaattgaaagggactaacacaatgatgatgcttttattatggaaaagaaaacatgatttgcatacagagtcaggtgagtgcagtggtgactgggtctcccagatggaggccagctcttccttctgccctttaaagggtccagcaacttctgactttgagctctcaaagcagcttccttgcttggtcatctcaaactccgtggacctttgtagaactgagaaaataatctggctttcaaatggtaattcttgtatgttttcataaagatgttggtgatgatgacatgatgttgctgatgatgtaaagtaggcaatgctagtagtagatgtagtaggtgtttcccctctgtttaatgtagatggcttcccagaaaattgcaatgtagcttttcacatttcacacacaaacacacacacgccaggccctattccccttttaaaaaggttttcctctctgtcactaacggagatttcctagaatcacaacttgggttggaaaggagggacatcaccagttgctcaagtttagttcatgggaaataatctctggctaccccagcacctgagcgtcctggtggatttcatgactgtatgcattgctcttgatttgcctgctagtgtatgggcacaaacaagggtttggaatttagaaatggcaacaaatctgccttttaactcttatgactacttctaagaaaattaaagaaaatgctatatgcattagattttaatttgcttttcatattcagagaccatctggaaatgtaattatagttcaaacttttaatctccagtgcctagacaagctttttaaaattgtatttgaatctgtaaacagacacgctggttttttctataatggcttatttgttttgcaataaaacagtgtaatgatttaaaacagggtcgcatacctgcccattcccacctggactgacacttagaatctgggatacatatggatatttagtgaatgagccaaatccctgtttttcattcctgacttttaagtacactttgtgtactacagtgggtgagacgttaagtttcagaattaatctaagatggttctgaacccaggtatcaccacattttggctttgtgtccttggccaaaagatttaacctcactgagccttggtcttattttttgtaaaataggagattataatagctttgtccttgggtttgttctgaagactaaatgagatgatatatgtaaagaatttagtactgtgcctggcacaagtcaacaataacagttttgttgtcattactgttattgttttaaagttgtagctactatttattgttattttattttaaaaaattcttgtctgtttgtcccttacataagctatctttggcattaattacatctacaaattcccagttgtcacttgatctgatttgctttacttccaatcacagtggtccctgctctttagcatgcagggctacatttgtcagtgattaccttatgaaataccctggtgcaaagccagaatttaatatgaagatcttgtcaggagagctacattcctagtacagtcacaatgttggcaaagaatatagttggactagaggactttttagatctttccaggtctgagatctgggacttccagagtctctaatctccgtaaagagaacagtaatgtcttgtcccatttctgtatgcaagagtgatgtatgtgattctgccagctttttccagaatactcactactagtgactaacactttttagtgttaaccatctaaaagattgggaataatgtcagtttgcatacctataaagtaaaaatgataccatgggaagggtatgctgcagtatgaacaagataatatgtttatagcacccttcacaatacaccttgctccatgctagcacggttagacattgtctctggaatgctactgtgatacttgttcattacgaccccagtgtagggctcaggaacttaactacacaactgtgtccccactataaccctgctctaaccaaatagtcttacaagcctccaatgccctgactgaattcaaagatgagctgatttttagataaacttgcaaaggaatataaccttaaatgatctcctatttataatttataaaacacacttatacaaattgataatgatgtatgtttgaataattcaagaaacaggatgtcaatagattttagcaccaagtaccaagaaagcttctgcttgtgaatattaatttgactaatttgagatattaggccatctagtatggtaagcatatttgcagagtagtaggattttcgaagggtaatctaatcagaaatgggccaactagcatttgtaaaaaatgtaacaattacctgaagatctcatatgagatattttgcaactggcaaagagcaagataccctaagtaaaatgtaactgagcaccaaattaaatattgggaaaatgtctggaaagaatccatagtaagttgctttgttttgtactgtgctttcctcctatttatacaaatacatttatagatgagtatagacatttatagtctgagtagtttcatttatatgaccacaaaagtacaggcagcaaaagcaaaaaaaaataggctggtgaggcttctgtacagaaaaagaaacagttaagggagttaaaggattacctatggagcaggagaaaatattaactgctctatatctaataaggactcaatatctaaaaatgtaagaaacttctacaactcaataacaaaaaagtaataataacccaattaaaaaatggaagtggacttgaatagacatttcttcaaagaatgcatacaaatgtcccacagatacatgaaaaggtgttcaacatcactaatcgtcagggaaacgcaagtcaaaaccaaaatgaaatatcatctcacacttctgagcatggccattatcaaagaaacaaactagcagaaaataacaagtgttggagagaggatgtggagaaattggaacccttgtatattattggtgggactgtaaaatagtgcagctactactgaaaacagtatgaatgttcctcaaaaaactgaaaatcaaaataattgaaatcagtttttcaaagagatatttgtactcccatattcaatgaagcattattcatagtagtcaagaggtagaaaaagcctaaatgtccattggcaggtgaatggacaaagaaattgttgctcatgcctataatggatttttttttttttgagatggagtcttgctctgtcgcccaggctggagtgcagtggtgcaatcttggctcactgcaacctctgtctcccgggttgaagcaattcttctgcctcagcctcccaagtagctgggattacaggcatgtgccaccccacctggctaattttggtatttttagtagagaagggtttcaccatgttggcgaggctggtctcgaactcctgacctcgtgatctgcccacctcagcctcccaaagtgctgggattacaggcgtgagccaccacacccggccacaatggataccatgagatatcattcagccataagaatggaggaaattctgtcaaatgctataacatggatcaactttgagggcattatgttaagtgaaataagccagtcacagaaggacaaatgctatatgattccacttataggagatctctaaatcagccgaacccacagaagcagaaagtggaatggtacttgctagggcctgggaagggctgatcagagtatagagtttcagtcatgtaagttgtaaagttataaagatcttctgtaaaccattgtgcttatagttaacaatactgtactgaacacaaaagtttaagaggtttaacataatggttattatatatgtataatatatgtatatataatacactatatatatctattatatagatatatctattatatagatatatatataatttttcatcatcaatgtgctaaatcctgaggatacaaagaataaaagtatattttgctttgttcttgtaacataaacctatatataaataaacagaaattgtaagtcagtataaaagccagatacttcatcgtcctgcaagtatgtaaatgcattttaaaatgaacaccttagaaaggggattgtggattcagtttccagtgactaatttatgtctacattgggaggaatgtgtaagtctaatacacgctttctatcattgttttattttaatcctccacacaaacttgggtaacactattctgtgaaccacctgagggaccagctttgtaaccctgagtggaggttaatatatattaaaaaatagtgttataatgagtgcactccagtctccagaatccaggttaaacatgtcatcatgaccagaggccattgctaattttactttcatgtgaatctctttttaggcttcacatctagttgggattatttagaaatgaccaagactacaattattatacacagtttattagaaaaagaaaaggcatttgcctttatgttattgatttatttacttgtgttagttttaagaaaagacaaacagatcagatatagaaacacagcaatgctattttctatcaaattcctctgggtgtctcatgaaaatcttgcatattgaattttaaatccaattcgtgcagcccagaatgacatttcagtatattatgagttgtagtcaatatattgattacagtctctttgggcttacaatgattaaagaccatcacatggatacagtatttgtttagcagacaattctcaagattttcatgtgtgatacagaagccctaacaattatattgtatgtgtgccaaatgtttttcaaggctattgaaaataagaaaatttaattaaaatggtgtgaattcatttaaatttgtatggagagaatgggagatataattatgagcctgttcttggttgtttattgcatgaagttggctacttggtaatttcaagaccatggtaaaccagggttattttgaagtcatcaacaagtcatccttggaaagaacttccaattcttaagcaccttatacctgcctggtatgctaaacatacaaactcatttactcttcacagccatcttccacagaaatgttattatttccaaatgtggaaactgagacttctagaggacacgtagtttgccaaaggccacacaaatccagtagggctgaacttagaatgaggcctccaaaactgcaagtaaaatttaaataaatacaaaataacttactttgattaaatctggactacattgagaaagcccttgttttgtttttatcacacagctctcataaaattattattattttttaattgcaaagtatgctaagtacaaaatggtagctccaactttagtctgaataactacaatctccactgagggatttctttccaacaacagtgttccatggaagcagagatgacttttgtggtctcaagtggacttggccctcaaaggggaagctgcctctgagggtggggttattcactccaactctgggggctgtgaagccatctccagggatggcatgaccagttgggtcttgaatggagagttacataaaacctcaggaattaatgatttaataccatattctgtatttattttcttattttttcatgaagatcttcataccatagggtctcaaatatttaggaaaaaaaatgtttggattaaaccttctatcacattactcttgccttgaattgtgaatttttaaaaatgaaatttcagttgggatcacttttgtgtccagttacctaatatatatataggcctaatcaataataaacatgactactatttatgcataccaggtgctctgctaggagcttttgtttaattagcccagtacactcacacagcccatatgagactagtattgtaaaccacatatacagatgagataatgggggtttagaaaagctcattagcttgcctaaattcaccaactagtgtgattaaaattggatgtgaatgcagagctagttgattcggaaatgggtgctttaataatactattcagttcctatattttttaacatatccccacatagtgtattaacatgttcttagagatatatggagaaggaaaattcacctaaaaatctataccagggaacagttagcaatctttgtttaggttcatctgaagtttctgtaggcagttttctggaataagcttctctatggctggtattgcatcagcagcagtttcaatagggcagtctctgtgtctagagctcaagaaaatcagagcctgggtcatggtaggtaggcaaaggctgaggcagcaatgtcactcttaggagggaagcaataacctaagccaaataaatggtcatagtacaccctcaacctaaggtattgtcacaaacagggggctggagcctggattcattcatcaaagagcatgcctgttgattgtgcagaaggcatccattttagagaatttggatctttgagacatggtagagcaaacaaaacaaatgacatttatttcacacttgatatatgccagacattatgccaggcaattcatttgcacaactttattgtattcttatcaaaatctattgaaaaaagtattgttatctcatttcaagatgaagatgctaggacttaaaaaaaagtttttggatcaacattatacagctactaagcaagatactacgatataaaccctttctgtgcatctttccacagcccagtgctgttttcctggagattgctactgaaagtcattttcaacctcatacctggaaagatagggaagccaaggcacagagaagatgaatgatttctctgaggtcataaaactattaagtgccagaaccaggttttactgccagtctatttgatttcaaaattatttcaattagatcattgccatctctatgttaatatatcgttaatccttaagaaaactgtcatctgacccaaactcccacaccagcagccaacttgcttctttgcttctgttgctgcaaaactcttttaagatgtatctacactcaggttggcagttcctctacttctggcagccagttcctctacttctgttctcctaactttttcagattgcttttcccctctcatgctcatacagaagtcatccggatcccatactgctcaatcgatgaccaattcccagtcttgggtgatctatcagcaaggccatcttgcccttctattgggtaaactttgttcaaatggctcctagtgtcatatatactcagtctttctcctaccttgctgaacaccctttcttacttctctccaagctcttcacacaggagcatcttttttttgatgctcttgtctcttgctttctcctcatgactttggtgaatttatcccatgttcataactctatgtatcacctacatttcaacaacattaaaaattatagcttcagctgagacctgctttccaaactctagacttgtatttgcaaatgtctaccttatatccctatttggctgtctaacagatatttaagacaatatctccagtacttgattcctattcttccctcaaaacctgcttcaccagctgcctctctcatctcaagaatctgcatctttctcattattgctactgttaacacactgatccaaaccattatcatttcttgtctggattatttaaaataaataataaaaaactaaatatttaatgggatttcctacttcaaactcagttcatctagggtctgttttcaatatggcagccaatatggcagcgtgaccaaaatgtgtcccgttatgtcattcccattctcaaaaatgacctcaccatctgactcagaaacagttgaaacatttacaatggtcttcttctgagctcctctctctttctctacacccatcataccatcacattccagctgtaggatgttggctgtagaattttgcactggttgagttgccctatccccagatatcagctttaataactacctcatccttttcaagtctttgtccatgttttacactctcagtaatccctactctgaactatctaacgaagtaaactgcctgccatcttattttgtcctcctgattctgcctatgctgttcccataaaatatatatatatatatatatataaaataaagatgcatcgctttctaacactctagataatgtgtttatttagcatggatattgcttattgttggttttctcccctagaatgtaaataccacaagggcataaatttggtctttttaccactagtgtattttgagcacttaaaacagtgcctgagacataataggtcctcaaaaaatacttgttgaatgagataataaaagtaagtatattgcagaccttttttagccatcttaactttgcagaaatttaagtatctaatctgaagtatctgagggtacatttttcccctcataatctctgctatttaactagtgtctaatttcctaccaattagtctatgtaaatttatttcaggcttcatataaaccactgagcagctcaatgatattgatctttactgccatttaatggggttggtcagtgatcaactccaggcaagaccctgaatcagcttttacttatctgccctctggcatgtaaataagtggacaaatgtctgcaaactcatgagacccttcctcttttccttaaatgttgtcatatgcctatctgtgctctttctttggttagaaaaataaagggaatttaaaatctttggaataacaggaagaactagaatcattcataagtattttcttcaactttactctaattgccctaagattaatctcttgttacaacagcaaagtctagcctctctagaattccttgaacactgtatttcaataatttgatcctcatggacagtgaatctatctgtcacagtcagttgtcctttcactctttgaatcaattggcgtttacccatatcaaactctatttgtccatcacttctaaaactcttgataatttccaattgctcatggagctgagcttgaaggttgacatggatcatccattctttccagaatgacaaatagcattacatggtgatcctcacattttatcttaatttcttggcaaatgttaatttaattttctgctaaatggtttcaatctcatgcagaaccaaagtgaactaagttaactatctcagaaatatcccctgtcttgtcaggataattatttctttcatttaaatgaaaattaagtaacactctctggtgatttttttagatcatcaacataatttctgatgtcactgtgaacctctgagacacgttaagcttaaatttccccctaggctcaaagtggttatatgaatttacttgttcaaaagagattgcatagaaacctaacacaaactgacggcatcttggagctaaaagtagtcttaggtattatgaaacccagtcataacagagtttgcaagtagagaaactgaagctcagaaaggaaagttgaatgtataagttcacattgcaccaaattgggcagagacgaatagcaaaccttggtcttttgacttagtccaataaagctataaaattacatgcaaatgttggtgaatatttgcagaacatttgtttgagaaacgtgtccttagcaatttatcacaaaggtcagtgatctctctaatgttaggcaccaaggtccacttcactattttacagacacagttggcccagggtccatgtaaagttaatccaagaatccatgtaaaactaaattgagctttgtattcagttttaaacaatagtaacttctttcttactaatgagcatggatggattagttgggtatccctgctggggcattggattgctgtgacttcagtgctctctggaacaagcgcagtccaggtgcctgtgtgtggagaagataaaacacttgatgttcaggtttgtttttttttttaatttcaatttttattttaagttctgaggtacatgtctaggatgtgcaggtttgttacataggtaaatgtgtgccatggtggtttgctgcacctatcaacccatcacttaggtgttaagcccaggatacactagctatttttcctaatgctctccctaccctgacctaaccccctaacaggccccagttcgtgttgttcctctccctgtgtctatgtgttctcattgttcagctcctacttataagtgaggacatgcgatgtttggttttctgtttctgtgttagtttgctgaggataatggctttcagctccatccatgtccctgtaaaggacaagatcttgttcctttttatggctgcatagtattccatggtgtatatgtaccacattttctttatccagtctatcactgatggacatttgggttaattctgtgtctttgctgttgtgaatagtgctgcaatgaacatacatgtccatgtatctttgtaacagagtaatttatattcctctaggtatatacctagaagaaaatataggaaataccattcaggacatagggatgggcaaagatttcatgatgaaagtgccaaaagcaattgcagcaaaagcaaaaattgacaaatgggatctcattacattaagtagcttctgcacagcaaaagaaactatcatcagaggaaacaggcaacctacagagtgggagaccatttctgcattctattcatctgacaaacatctaatatccagaatctacacggaacttaaacttacaacaaaaaacagccccattaaaaagtgggcaaaagacatgaacaaacacttctcaaaagaagacactcatgaagccaataaacatatgacaaaaagttcaacatcactgattattagagaaatgcaaatcaaaaccacaatgaaataccatctcacaccagtcagaatggcgattattaaaaactcaaggtacaacacatgctggcaaagttgcagagaaataggaatgcttttacactattggagggaatgtaaattagttcaaccattgtggaagacagtgtggcgattcctcaaggatctagaaccagaaatatcatttgacccagcactcccattactgaagttcagtatttctaaacagagaagataattagttttttatcttctgttgacttctacctctcctccgcaaagatttcaattagtaaaaataaaagctaacacacacataggtaagaaaactcaaatacgatctccttttgcaaaatttttattatgagattttgaaataataggacgtgtgatgatatgtaaattccttccactatagcttttgaggttgtgtgtgtatgtgtaagtgcgaatgtgtgtgtgtgtgtgtgtatggatttgcgtgagaattagatattaacattaaaaaacttatttttccatcatatatcagaaaacatgatttttaataaatgtatcatctaatatgcaaagatgtattacaagaaaaaaattaatatgcctgctttgccactaaatccatcacccccaggcattctcattctcccttctaaagcccatttttcatctgtaagtgaaagaattgaactagtttgctaagaccctttgttaataatcagtgtgtatgtggtgacttgctactaaactcaaactgcaggtcacctccaccattttctgagacagaaattgtatgagcagtttttttgcgtgattgaaaataatatatgcatgtgagacattggcagctaagaacttggctattatatgcatatcagacaccgtgataggctgatcctactctttcttttttctttttttttttaatttttgagacagtgtcttgctctgtcacccaggctgcaatgcagtggcacgatctccactcactgcaacctccacctcccgggttcaagcaattctcctgcctcagcctcccgagtagctgagattacaggtgcgggccaccacacccagctaatttttgtatttttaatagagatggggtttcatcatgccaggctagtttcaaactcctgacctcgtgatctgcccgtctcggcctcccaaagtgctgggattacaggcgtgagccactgcgccaggccgatccctgctctttcttaatcatagctttgaacagttgtagtcccaaggctatccctcttatggttttaaagttgacccttctggcattataataagttatgcactctaggatttttcattgagaaaagactaagaattgattttaatctcagatcttacagttcagcaaacagctttttcctacttgattttttttttgtcccatatccctttcccatgcatttctcttttgctcttctctcccttccatttacccaactaggtctcacatctcagaatcagatgtaatagatttttgtgtttccacctagtactgttttcccagagtaatctgggaaagttgggcacgcctagcagacaacatagactttgtggaatatccttcttccacaacttaaagggtcttctttacaaaattacaaatctttacaaaattacagttaaaaggtcttagcagaagccctaagaaagtgggagcccaaagggtaagcctcatcaaattcctggtaaatccatatatgtccatctctgtctggctgtgtctacttttgtatgttccaatgttttagagtgcagacacacacacacacacacacacacacacacaaagatgcaaaatgctggtgtcctgccactttctctttggcagaatgtgagactaaaaacattctcagtgagttcttgcctaaagaatgtaggactattttgaaggctccagaggacaattaataagattttatttttctttttattagaatttacatttattgacgttcataaagaagctgataactgcttagaatatgaactcagatatggtctctctgacaagatgccctcctgcacaaaatgttggcattagcattatgcatgcaattgatgtgatatattcagaattactctgaaagaaaagaagaaaatgttaaggagactgatacattcaaacaattttaggtttgtaacatggttgttagcgataaaatttgaagaagaattaagggtgagagaaaaagtaattggcctccagtaaacacctctcactgccagtacaaggcaaggagacaaggtcagcattcatatttcataagcctagtaataacaccactgtaatctgcacagctactttggatgtgagatgatattctatttctgggggagtcagcttttctttatgtacagtatctctcttttcccatttaaaaattatttccattcattaaaaaagagataaaagaattacaaaactacctcccttgttcccagaactctctattgacatgattgtttatttctctttctgcctttaatgtctttataagtatttatttaacttatttgagaatatattgtctatgttttatcctgttttattctctttacatatttctatgctaacattcctcattgtaaacagcctttttgcagatgtttaccttaaatatcaaacaccaaatatcaaagtttactaaacttttcctcccattgttaaatatctagattaattccaaattttcttcattaaacatacattgccgtgaatattttctatctaatcagtttctttattttagattacattcttagaatatattcccagaagtagaattagagactccaaggatttgaatcttttaaaaagtgtttttaatacatggttccaaatctcataccaaatggaatacattgattttcatatttaatatctaaatttgtgaaatattctgctgaattaactttgatttttttcccgtcagtctttaattaaaagttgctgtctctctcagttacaggactagctaccagatttgaactgactgccagtcattctgggtaaaagcgtcaggtttttcttaactctgttgagtatatatcctattcaaaaaactgagttttttgtggggcaaataattagcatgaaatgcaagttggctctcttcatccttctcgttaaatcttgcataccatcttaaaatacttgaacttttctttttaatccataataggcaaaataaatactcaaattagcaaacaaaaatcaaaataacagtctttataaaagaatagtatttcaccatgattaacattttcatgtgtggtgcacacttatacaaaatgagtttttgaaaattttattattcccctgcagccctccagcccagaataatcaccattctactctctacttctcttcagcttttttagatttcacgtataagtaagatcataaaatatttgtctttctgtgtttggcttatttcactcagcataatgtcctccaaggtcatccatattgttacaaatggcagaatcttcttctttttaaaagctgaatagtactttagtgtgtgtgtatgtgtgtgtgtgtgtgcgcataaaatagaaccacactttcatgactcattcatccatcagtggacagttggatcatttccatatcttggttattgtgaataatgttacagtgaacatgtgggtacagcaatttcttccagatggtgatttcattttctttggatatatacccagaagtgagattgctggacaacatggtagttctattttcaatttttaggagcactcatactgctttttcataatggctataccagttctccccaccaacgatagacaagggttcctttttcttcacattctcaccaacacttgttgcctcttgtctttttcatgatagccatcctaacagttttgagatgatactgtggttttgatttgcatatctctgctgactagtgatgttgcacatcttttcctatatctgttgatcacttgtatgtattctttggaaaaaaatgtctgttcaggttctttgctcattttttaattgagttatttggtttttttttttctaatgacttgtgtcagtttttaaaatgtattagatattaatccttcatcagatatatggtttgcatatatattctcttattttatagcttatcttttcatttcattgattgtttgctgtgaaaaaaaatccatcattaaggggaaataaacaagggtgatttttttctcactttgtgttgatttttttttgagacataatttgagttgtacatcactaattagaattgagataaaaagatggaagaaagccacttccacagcacgttttatatgaactcgcaggaagcagaagtatgcagaagttagaagaggcaccttgagctcaaaatgaaaaaattctgtcttttaaacatcactgcttgtcttcatcagaaaccaaatgtgacttcttggtagggatgttgtaaaggggtttaccattggtgggtagatgaattccatgaatttaaaattgcttttcacctttgaaatttagtgagttcattacagctgggaggcagacctatgggattcataaatggctgagaagaaaaggacatgagattactaggagaaaatacactctgatggaagagagagtcactcccaaccgttggctcaggagtaagctttagttgtcgatgaagaggagtggtttagagaattgcctgttgcctgtcactcaatgttgcctcaacccaggtattcatatggcactgtgggggttcttgagaaagcataagcaaaaacttacagaatttttttcggtaaaatcctgtaagccattaaggtacacagtgtattatgcagtaaatttaggtcacccatttcatggcccacagctcagtttgggaagcttgtagactccagatgagactccagggcatcaacaagaaagcatgatgaaagcattgaccaagaaaggtggaaacatattgagtagcaggaaccaaagcccatttgaaaaggaaatgccattagacactggtggttctcagtggaaacacaaagatgccttgagaagaagagtctggcctagtgacaagtgaggagtactgaattcagctggaaaaagaattctcttttttaggcaaactccataccacttgaggcaaagagccaacatgtattccctacaatctgagctgtaactcagtttgcttttgttttttcaaacagttaaaaagagacttggctggtactttcaaaggggaaattgagataactaacaattttggagaaggaatattgcattttcaggttcatttactatgaatgcctaccaaagcaattacagacaaacctttctttctttcctagaagataataaaaatgataattagcaatctgctccttcatttcttcacatgttcttgaccttgccttgctatttagggcttaccatatacagatgatttttagaaagaatatgatttaatttcttttagaaattaaatttctaacatttagaagcttcgttttcttaaatataaatgttttttcaaatggtctcaaatggtctctaagcaaaaaataggacaatagaaaagacctctgttgctactgtttcttacattctgggaagttatataagctgaatatgtgtgaattgaatgatatatctttaaaatatttattggttaggtataagttataaatcacccataatagtttagttaaatttattttacttttatgattatatacagggcaaactagagactttgaggtgtgaaaaaccttcaggtaaattctcactccacggtgtacaggctaagcctcagcttgaaagttgtgataatctaacaaagagttcttgtgaaggttaaatagaatgaagactagaaaacatcttgtacaaaactctctgatttcaagtagccttcattgtgagtataaagctgagacaaatgaccttgaaaactatatatgaataagggctaaagtgtcagtccaggctgtagttgcttgagaaggacaagaaaataaggcagccatcagagcagtgaggacatattgaaaaaggagaggcatatgctagaacttggaggaggatagggatgtagtaggtcatctctgagcccctacataagtcctgaagtctctatttgatgcttagaatgaccattaccctgaaatcttacaattagcctcttagtttcttcctagggaacatttaatgattactggctccattaagtgttgcattaagccagaaattcagtgaaaccatattaatcacataaacgtaaaaaccagaattagcctctgagctactttgttcctcagtgtccccattgcatatacttggcaagtccacccaaacctatctctttaatatccatgggatccgtccatttctctccatgttaacttccatgactacatttaatactacctttttgtaggttgaattatttcagcagtttcaattgccatccttgcttccgctgcagtgcattgttcatacaaacagcagctagatcattctaacttgcatctgatctgctaaaatcctttcagtgggtctttagaatctttgtcctttggcaataaggaggaagcagtagaacaagcttgtgtctgttctaaacagtgactatgctgctttgggtaggaatcactggatttatagttggcctatactgaacttttggttctatgtgtctaaggggtactcatcttacatatgaaaaatgatctttccagttgaaaaatgatgttatgtataaacctgtggaaaaacatgagagtgtcctaaactcgggtatcaacaataagcctagtaaaatggtatcaagtttaaaggtctagatggtagatggttatttaatgagaggtaaggatggagtatgatttagatttataggtagacaattgggggtataatgtcgttaaataagatagggaaaagaatatgctgaactttgctaagagggaaaattaataaatttaatttgaacatattgtgtctgggatatctctacctccagatagaggggcttggttgtaggctattgttgcaaactatatggagctggtgagagggatccaagctggaggcagatttggaagagatcaggacattggtgatgtgagaaggaacagatgggaatgggtggaaatctaagcacggccaagtaagaaagaagtggactggagatagagctgccatctattgtccacactgtgcattcacctcctactatgaccctagtgcttctgcctatgtcctcccttaggatattttcagcaccgcaacaagagcaaaccttttaacatagaagttaggtcacctcactcccctgtctgaaacctgccaagggctccctgttacactcaggtcaaaagtcaacatactttcaaggttccgcaggccctccatgacctgccagccccttccccatgggctttctggtctcttattttaaactctcctggccccttcattccatggtcccttcgttccattcccaagtgttatctggcttacttatctgccaatataccggggagcctcttgccttagcccttctcagtggcaaggctattctctctaaaatattattttcccagaaagtaccatgtctttctctctttcctctctcagatctgtgcttaaaggttgaccatgcatcaagtgttggttgaccatattttagtaactcaattctctaaccaccaaaaatgggactttttagttctatgttctgctttatcttactccatagctgatattattaatatttttatcctgcatatttcattatttatttgcgcattgtctctcccaatcaaagtgttagcttaatgagggtaaggattgtgtctcttctgttcactgctgtgttcatgacaccccaaacactgcctggcacataacataggagccgctcagtgaatgattgctgaaggactgaatcaagatggggatgaatgaaatccgaagagatccagtgtcttaagtcataggcagcagagagagggttcatttgaatgctatgggtgagataagcatatgtcaagaaatatcttggcaggagttgacataactctgattgctttctctaaaaaaattagggttttttttgtttgtttttttgtgttttattagcaatctaaaagtctctagagtgagcttgccaggttctggagtcctgttcctcatgtactaacacacactgatgtgtgaatggtaggcttgtgtgaacctgttcaggtcagcagtatccttcccttgctctgatcattttagactcaataaaaaaatcagtttagcagcacaacttcccaggttttcttggtgtttgtgttttccctcagatacattgtaaaaggctttattgcaggggcaaagtactttccttcttctcataccttccagtgctaagcacctaaataaagagcaattgaaattttattaattaaatattaattgcatttttctgatatttcaatgaaaacttctaagaaaaggtgattatatttctatattttggcaagaacactggaaccgaagtcaggaaatataaactggagtctcctgtcacctactttttaagtgagtgactttcgaagagttacaaatttctttgtgcctcagtttcctcctatattaattgtaataattatcagtcctgccttaaatcacactagtatggaatttaacaaggtaatttaaaaattattttctataacataaaactttatgaatttcatttatataactgtctgtggagaaactacttttccctaggatttctttgtagatcctctgaatcagacaattctaggtcttagtatgtgaaatgcacatattttagatagtcgacttatttaaaatgttattctgtttctggatttgcattcttttgccttccaatttgatttgtctgatatgttgtgaagagtatatgactaaatgattataaggtatttctggagttattaaacggtgcttcttgtctcaatggaaataacagtttcattttgtagcttatccattttgactagaagaaagcccagaagtgaatcagggtgtgtctatattttgtacctcctaattgattttcaaaatgatataagtgaaacagaagcgaagggaagattgaaatttacaagctgtgtaaatatttccccatagaaataagcttatgaactttagaagagggtgagggagagatgcattttagaggcatgaccaaaatgaatactgaaagatcagacccacatggactgaatcattagcttggagatctcaggaaaatctggtgagtagaatcttctgagagaaggaactttggtagtagaaagtagggtgtaaatccactgatttcaagaagatgtaagagttttacctccacttggtaaggcatgtatatctgaagtcagtttctgtctgctatggactgacttgaggattgactactcaatcaacatatatctataaaatatcatgcactaggcaaattgtgggcactgtggtgaagaaagcttatgacagtagatctcacggggccctcaatctatttagaaaggtagtttccaggccaataatttaaatagtttttgagtgtagggcagaacactgtgggatactacaactttggccagtaaggacacctaacctggtttggaagctcaggaaagattatatcaaacccagtactaaacatttaatatcccaaattccagggtttacacaacctcatacacagtcatactacttatgagaccagtgctttcatttgcatgcagtcaagctatggaatgttgttcagtcactacacttcatgcttttgaactaatgtagtggggtgtactttaaaggaggcagacggcctggacaacagctgtgtataaggtaatctttgaatgtcatctgttaaatggaaaaaaaatgccactcttacttctcagtttgctctgaatatgcactgaaatactgcctgtagaagatgaaccaaagctgacacttattaatgttaggtctgattttctgagccattgattgtgacattatagtaagctcttgtctgtggatttggtttgtggtcttgattcaccttgcagaagggacgggtttctataactctgtgcccttcatgaatgatcagtcagatgccttctaatggggcactcattgagtactgtcttgtgtttgcagcctgaatgttcttgtgttgggaagagccataccagaatctttcagataaagcaatgggacacattgtcatgtatcacactgttatcaacacatctataagtggcccttttcctcagcatagcattttttttcctgggtattatggatgagtttcccatgctgtggtgtagccaaagttgtcctattaaggaaagtcacagcactttggatggtaaggcatgataatgcaattctgaaggggattcttaatgtacggatgatcaaaaggtgaccctaagggcaaattgataattgtgggaagcccagtgcttcccaccagtgtacagagataggttaatttatatttccccacaggtgtttgtctgatagactaatgatgttaagcagaataacaaaatctgcatttaaatgaatgtattataatgtggaaaagtaagcccaaatacaaagtaagcgccatcacgtttgggataaaaacaaagtacagtatcattagagtcctctgggaaaacgtttgtctgtgatttatggtcttattttggagcggctcttatagaccctcctggaacccagctaatgaataaatgataattctacccctctatacatcacacttttttttacttttttttttgttactacagcataaacacacattcccattagattaatgtttctaataaattaggaaaaatgctaagtaagaaagaaagggaaccaaaatggaaaattcagtgaagtacagactctatgggccaagagataatttacttttattagttttttctttaagaccatagtgaaagtaatgatctagctatttttattttaaatattgcacagataattttggaatcgaaagtggaaccaattatttaaagtcctaccctcgtcttccctgagacttaaatagaaacagtagggaaatgcaaagtatttaactggtatgaaactgagagcaactaatcagaaagaatgtcaggcataatacaagagtagaaagaatcctagctgttcactgatgtgccatgtgttaactctttagtctttgaatagcgggaagatctgaggacctagagaaagggccagagtagccacaggggtggtcatgtggcatccagagaacctgtagctatttaccaactgattgagaagtatttcagtgttttaacaactggtatcactgtacatgccagtggactgtgagccctgaagagatagaccattgagttctattttcttgtcaaattgggccacaggaagtctcaggctcattgagatctagttagggctctgtcactcactagctgttgacgtttgtgtaagtcagtgcacaatcaccccagtccctttctccccctttgcagtgatatggagctactactacctacttggtaaggctggtagatgcatatgactagataattgcatgggatactgcaatgcaaagtctgaagcatgatacctgtctaactgtggagaacccctgattttgctttgtccgggattctttttccaacctcactttgaagaacccctgaaggcactgaacatctagatatcctacatcctgtggccaaggggcaggcagaaaacctaagctcatgcaaatttatactatctcctaacaattgtatttttaagaagagtgctacaaggatttttaatggttaaaatttatttatcttgagacaagtgccattaagagactgtgcaagggccaggcgcgtggctcacgcctgtaatcccagcactttgggaggccgaggcaggcggaccacaatgtcaggagactgagaccatcctggctaacacggaaaaaccccttctctactaaaaatgcaaaaaaactagcgaggcatggtggcacgtgcctgtaaccccagctactcgggagactgaggcaagagaatcacttgaacgtgggaggcagaggttgcagtgagtcgagattgcgccactgcactccagcctaagccatagagcgagactctgtctcaaacaaagaacaacaacaaaacaagagactttgcgaggaatgttgcaagctgtcccagtgctgccttgatgcctcttcagacaaggtactccaacttttcctttgattccttataagtaatttcttccaacaagttactcttttgcttaaatctgacacatcaagttttgttgcctgcagtcacagaaactttttgtagagaagtggccccttagttttcaaagaaacacaaatgccactgcttggggctttcctctatctgcttggaatttcttcttccttccctctctcccttcctccttttcctctcttactccctcttttcctgcctacctacctttcctctttctgtctcctgtctttctgttttcaattgtgatatgtagaatcaattctgcatcttctaaataaatcagctgtggagcaggcttccagtttcatggaatttacatgtttgaggaacagatttgagaaagcagtctaacaattttttatgcattacactataaaccaggaaatgtatccagaatgaactagttactcacataaattaattcttaggtaaagctcacatgctatggaatggtttacctgactgaatgatgtctattcctaaggaagtaattttcctgattgtagctgtgatcacgtctcagggttttcacacagcatctcaggtggttctgtctcctgaccaatttcactgcctttgtgtgattatcagtgaagttacacagcagtacaggtaagatatgctgtaaggactgctgttcatgtcaaaatgtaatcgtgaggtgaaaattgtgttcagaacaatgctgtcccaggcctattaaggacaaaggagaatgaaagagcaatgtgctgtcataaaaccttgtataatgatttcaagccatgctgggccctgacagctgagggaggaacaggaattgagttgggaccatgcttcctaaacttatgcagctaatttagtagtagggatgttgtctctcccatgatgggttcgcagtgtaaagctccatgcctgagggagttggtacaatgtgggcatgggttgatttctagcagtacaataaagagagagaagtgaggtgagaagaggaagcttatgggcatgttaggccctgcctgggaggttttggaaataaaaaaataaaaacttcattctgagaaggaaaagagtaatacaagccttggtgcaggctttgcctccaagcctgaagggaacaggtgtgaaaaacctatatccagtccactagaatagccctgcaatgaagacacaaagcctgtagctggagtgtgtctgtggatgccacatctgactctgctaaacacagcagacccaagggtgggaggccactgaccatcctatctcagtgtctgacctggcagttttgagcctctgggtggctactgggacaggctggagaaggtagtgacctcaggtgcagtatttgggactaggtttctgaaagctacttgtgtattctagaaacatgcctgtttctcctctgtgcagaaaatagcccctaaggaaggggaacatatacatagagaagtagtgactgtttgaattaatcaatttatttattatttgtctgtttctctgctgactgcagacagaaaaaataaaatacagtggaagatcagataagggcaactcacactgtgacaaaggattttactatggaaaacattgtcaaatcatggtaccttgcctatccaatagcatttctctaataaaatattttctcaagaaggttattttgcaccaattaaacataaggctttgtcattaaatgttccaaagtttaaattgagttcctgtgggttgtatgtgcatttagtagtctgactgctttcccacaagaaatcaatatttctctaagatttgtgggaatatactattcattccaatagagacgattaaaatgttaacatgtaacaaactgcaaatctggcatggaatgcattgttttcatacatgcgtttagaacagaaactcagattggccattgtttatggggagttagagtatatcagacatgacaaatgtgttattctccccagataaatgtattttagcctgttgacaccaaaatgctcagggacctcaagttaagactgaaggtgaaaaagaaatacaatggtggaagttaaaacatcaccatcctaaaaacaactgtagtaaaattaaaattctgaaaataggcaacagcaatgaaaacaccaaaaatccagagacaatcaatatccaaaataataactacaaaccattgaaagcaaatcctcaaaagtatgtttgaggttcatggaaaagactactttttagactccacaaaggttggtggacttgaagttgtgcacagatctgcatttagtgttgtttgccacttcttccttaaattttctgctgacttgaattcaaagcatagactttatcgttcagactggtttttgtttttctagatcaactgttgaaccaagtgggatgctggaacgataagcataaactggaactcttccaggcaaatcagtataatagtcaccctaatgatgacccattcctgggtccttctctcatgaccattccttgtcagtctccctgcctgtgaatttcactttcgtccacacttcaaatgtagagtttatcaggggttccatttttcttcatctttgggagtgacagagttttcctagtgatcttatacacttacaacttaactccctaccttgtttctcatgacattcaaagacataactttatctcttaatctatagacccacatgtttactaattactatcacagagttttccataaatagctccaggtgaacattcctaaacccaaactcattctccatatcccccaaactcccctccctcctctgtcttctgtcttggttttcaccgtctaactagttttcttctccttgccatacttctactctgcaatcaatgacaacagaaacagacttttcttattttattttaagttcaggggtacatgttcaggtttgttatgtaggtagactcatgttgtaggggtttgttatacagattgttttgttacccaggtgtgaaaagtgttgacttagagcatattttgagaaaattattatgcaaaaagtatctaggtctacattttctgatgtgagttacattacaagagaacctcttcagtaaccacagcttgctataatttcatgttagaaaaagcaccatattacaaggataagacatgggcacaagccagtcagaatgcatgcctcaacaaatcaccataaagcctggccctaaacaatcagtaagcacttatgatgtataacagctaaatatcatttttgaaattaagtaagactcatggctcagaaggggaactaggggagtggcaagactccaggacaccactgtgttcccccactaactggttcttccatttttgtcactgatttacatgtgataaaatacacataggattattgaattcctgactgcataattacgactggtattttcaaagccaacagaataaaagtgttcaacctgacctataggatccattatggtcaacctcctgtcacctttcttagctcatatgctgacactctccacaacctctgtccctaccattctgtactgtgcatttgcttttcctccaacagaagaaaatgggccccatttttccggggcctttctactcctgttttctcgcagacaaggttacttctccctgcacttccctccctgtgctgcttaccaactacccctgaccaagtatcccctttgtgatctagtggattctaactcatccttcaagtctcagctcaaatataccattttcagtgaaatatttatttataccaaactcctccatacctctagaagattaatcatttgcttcccttggtctctgtacatccctctctgctagccctcaacataccacattccaatgatatctatttcacacactatccccagagactgagcttccagaggcagatactaatcttatcattgtttccatcgtgcatctagttaggtctcaatgggtatttgttagataaatttcaaattcccacaagtgtgatgctgacaggtcataagcgcaggccccttccatggaagaagggctctgctggtgaaacatggaccatccctgtgcagacattcagcagaaagtctatgcacactctttcttattttgatggtttcagtccaggtcttgccaggcaacagatgatattcccagatggtacttttggagagactttcccatagggattatttacccaagtatggatagagttaaaagaaccatcaagaaatgctactccattagaacggaaggaacaaggggcagaatggttatacccaaggtccagttgagaataggagtcatgaaagagagatataagatgaagtaggctaaggatattgagttctcttcccttttatctccgtatccttgatcctttcttttttctttctgctacttccctttcaccatttgccaccagaagctgccagagggcaaggaaatccaggcaatgcatcccattgagatcggctccttgggtacagagcagggtggaaaagaacagaaaataaataaagggtaaagacaggacagggacctaaacaggattgttcaatcttgaatgcctggcacttccaagaggcccaggacacatagaaaagaaatatttattacatgagtgaatggatataagtaggagcaagtctcctgaccctcacttattccaaagactttttcatttcaacatttctgcatgttagcctgttgcaaaaccacaaatctgctgccaaaaggtaaggctggatgtttggttctcttatgaacaggagaagactggcctataactgtggacacaagggaaagcattttctgacattcagatcatttggaagcatataaaagttaaatctgttctacattgtgttggaaagaaagaaaaaataaacaaacaaacaagcacaacaacaacaaatcacagagaggaaggaaaaaaaagaaaactgatgtgctgtgtccccaatttgtgcacgattctctgcagtggttcaagtttatcccagcttatcacttaaaatcaatgacctattttcttacccttgcctacgtattctctgtatgatgcactttgaaaagtgttgctcctcacacaaacaatatcaaaagccacctgggtgagttgtcactccttgttactcatccccgctgggcaccttcgggaaatgagggtgaatttgaggaggattcagagctggtgaacaagtcccacagagatgtggtggggaagagtggcaccagatagcacagaagctggccattttatttctcatcaaaagagcaggaaataatatagtcaataagaagcaggaaggagccaggggattttgtgaataaacaccagagtcactggaagaaaggacagaacaaatccttcacgtagccttggatgtccttgttctgccctgtagtgaacaagggaaaggggaagagtgtgatgaatagatcatgtcaggaaactatcagacacctcagcttctctcgtgtctactttatctcccagtttagagaaaaaaaaaaaagatttccttcaacttttcattgtaagctattgtttgggcttataacaggcatattcaaattgcagatggaaatgatttcagaaactgtattgttctttttgttatttattgtttcatttttaagaccagaaaaagcacacctcttagagagtgtgcctatattctccaatgaatatcgaagataattttctggtatattttctgataaataaaacaatataataaggtagttgctgatatgtgcatgcaaagctgaagtttattgttcttacttttctacattttgagcttattataaaatctatgaaactttcaaatatgtgtaaatatataaaatatacatatatagactatatatataatgaatatacatatacacattccatacacgtataatttatttttatttatcttttatttttttttattttttgagatggagtttcactctgttgcccaggctggagtgcagtggtgtgatcttggctcattgcaacctctgcctcctgggttcaagtgattctcctacctcagcctcccaagtagctgagattataggcatatgccaccacgcttggctaatttttgtatttttagtagagatggggtctcaccatgttggccaaactggtcttgaactcctggccttggcctcccaaagtgctggaattacaggtatgggccaccgcgccctgccatacatgtatattttaaaggttaataacaaaaccccaacctgcccaaggcctacttaaagtacgctctcagtaagtttcagcacttttatgtcactccttcattgcatgctattctgatctccgccagagtgaattttcggtagatttttttccttgcttctctttttagctttatcatatatgtaagtataagaaacatttaattttatagttttgtgtttttttgactcctatataaatgaaactgtagtatattcctttgtaaacttgtccttttagttcaatatcatttttttaaaattcattcacaaagataccaataattgtatttcttcattatcactattttataatattccactgcatgggtatgccacatattttttcctttttattttaatttctgggatacatgtgcaggacgtgcaggtttgttacataggtaaatgtgtgccatggtggtttgctgcacctatcaaccggtcacctagatgttaagcccagcatgcattagctatctatcctgatgctctccctcctcccacaaccctcgacatgccccagtgtgtgttgttcccctccctatgtccatatgttctcattgttcagctctcacttgtaagtgagaacatgcagtatttgattttctgtttctgcattagtttgctgaggataatggcttccagctccaaccacatccctgcaaaggacatgacttcattcctttttatggctgcatagtatttcaaggtgtacatgtaccacattttctttatccaatctatcattgatgggcatttaggttgactccatgtctttgctattgtgaataatgctgcactgaatatatgcgtgcatgtatctgtataacagaataatttatattcctatgggtttatacaataataggattcctgggtcaaatgttatttctgctctttaaggagtctccacactgtctttccaatggttgaactgacttacattcccatcaagagcgtaaaaagcattttattttcctggccaacatggcgaaaccctgtttctataaaaacacaaaaattagctgggtgtggtggcacacacctgtagtcccagctaattgggagactgaagcaggagaatcacttgaacccagaaggtggaggttgcagtgggccgaaattgagccactgcactccagcctgggcaatagaatgagactctgtctcaaaacaaaaaagtaaaataaaataaaaatagttttcctatttctccacagccttgccagcatctgtggtttcttgactttttaataatcatcattctgactggcatgagatgagatggcatctcattgtggttttgatttgaatttccctaatcatcaataatgttgacctttttttcatatgtttgttggccgcatgtctgtcttcttttgagaagtgtctgttcatgtcctttgcccactttttaaatgaggttgtttgttttttcctgtaatttgtttaagttccttgtagattctggatattagacctttgttaaatggacagatggcaaaattatttttcccattctgtaggttgtctcttcactctgataataatttcttttgctgtgcagaatctctttagtttaacaggctccatttgtaaatttttgcccttgttgcaattgcttttgacatttctgtcatgaagtctttgcccatctatgtcttgaatggtattgcctagattttcttctagggtttttgtagttttgagttttaaatgtaagcctttaatccatcttcagttaatttttgtatgaggtgtgaggaagatgtccagtttcaattttctgcatgtggctagccagttctcctagcaccaattataaatagggactattttccctattgcttgttttcatcaggtttgtcaaagatcaaatcgttgtagatgtgcggtcttgtgtctgagatttatattctgttccattggtctatctgtctgtttctgtaccagtactatgctggttttttttgtttgttgtttgtttgtttttgtttttgtttttacagtagccttgtatagcttgaagttgggtagtttgatacctccagttttattctttttgctgaggcataccttggctataagggctctttttcgtttccatatgaattttaaagtagttttttctaattatgtgaagaacttcaatggtagtttaatgggaatagcattatatctataaattactttgggtagtatggccattttcacaaggatatggcacaaattgttgatatattctagtggatacttgtgttgtttccagttttgttattgtttttctttttgccgtgttaaatgagaccactagaatataaccactggatcacagaatgttcatctatgtcttcctaaggtaatgccaagttgttttccaaagataataatacaagcttccactctagctgccagggtgtgagggcctctgctgctccacatatgctaatatgaggcagcacatgggattgtcagactccctgatttttgctagtctgttggagatttagtggtatctcaatgtgattttatttatatttacttgaaaactatatgatgtaagtttccagttgtgtctaatttcaaaagaaaaaaacaaacaatgtaacagaacaaaacaaaagcaaacaatataacaaccaaatggcaacaacaacacgcacaaaataaacacccaaggaaccttatttaaattatcattcttgagccaatgagtaatttactgtttttgttttaatgtatgctctatcttcatctgttaggagattacctcactatacagacagattctccatacagatcaacctaacagtaagaaatgtgtgtgtttggcacagtgccttgggaagaagagctgctatgtgtcattgatgactctattgtttcaccagttttcctttagttactatacaaatgggaacaaggatgggaattagggaaattttccaagtgtaagaagctttcagatcttctcacatcacttattggatatgcagtgacacattagacctttattttgtataaaagttgtctgttccttctcttgcttctccttcttccaaattgttgacctgcatacaacatcaataacaaacccattaaacaatttttaagccaatttagtagccaccacttccaggtcactaccaccataccattttgaaagtggctccacacagggcttcttctggaagtttatagtatccccattcagggccaactgtgcaccttctgcagaatgagatggggttccccaacttttgtgtatgttttttaatcctctcttattctgggatgttaggccctgaaaggacacaggaacagggctgatcatgcgtgctttcagggcccaaacatccaagacagtttgtaccaggataaccccaatagttgttaaaatattgaagcattcccatgcaggttggtcaataagcaattgtctcagaacttgtatggccaatcacaatgggaagcctctaagactcttttgtagcagcatagattggtgtctattttgaatggttggaacattgtgtgtgtgtgtgtgtgtatgtgtgtgtatgtgcatgcacctgagttagtggaagtaaagtaaggggaagagaggaggcaatgaggtttgtctatgacattctcactctcccaggttgcttcttttctttacaaaatccagagcagaccactttcaattttgctttacttccctttccatctatctaggacttactgcagcagacctccaggttttgtatctttactttctcccaagatcagcctcatgaccagactttgatggttggtggagtaataaggggagtccaatcaaccaatatactaagtataaggaactgaactgggagccatttcaaaaatgtatctatcatccacacacacacaaataatgcataatgaccttttgggtagattttaatgaaggaaaatgtaaatcctcaatgcaggttgcaaaaaatgaggatgtcaaagtaacccataataatgcctcttgtattattcatggtctttgatgaaagattttttaataaacaatttcacctttatcaaccaaatttaattacatttgtaccaggataattctttacttgtttggcttagaaatgacaaagcttctttccagattcattatgtatttttaggatttttcaagaaatcaggaagtaagagttattttcaaatgcttttacaagggtgaccaagaggccagtgttactggaaaggaaaaatatatgatgtcaaactcaacccactgaatgccaaaaataagaaggtattcattactgaacccagttttattggcagggaaaaatgcaattgaaaataccaatcaccagtaaagcatatatgaaacaatgctctttcgtagtcattttgcatttaacaagtttttaatttttttaaaaaaatgggaatacataagatgcttcctatgcaaataaatttcatgaatttcagtgaaaatactttgttttcatcccaggttcaccacactctttctatctgacagatttttttttcaacagaatatgggagtgattttgtccagttattcttctaggtctccgtggaaatttctttcttttatagataccatctggcctaatgagattctaacagttctatacacactctgtctttctttgtatttgcattttttcactggagtcattgctggtagtgaaatggaaaaataaggggaaaaaagtatgtatgttaaataagcatggcagttttctctgtcatttaagaaaagtaattacaattattcgtttgatttactgaatgtaagtattcagtttgaacactgtccaaaggatgttgccttacttaaatatccagtgatcctaaactaaaattgcggctgtagtcactgatgggtttagtctaggaatatataatcttgtgtgtcttcaaaatgttaggaagaaatcttcttaagcaggatttcattatgtgttttcaatcactaatcttcactccttgtctctctctctctctcaccccgcccccccgtgtgtgtttgtgtgtgtgtgtgtgtgtgtgtgcatgtgtgtgtgtgtgtgtgtgtgtgtctgtatgtttctgtctgtagaattaggtggagggttggtaagaataaatacaatcctacactgagatgtagaggtagcaagccaaatttgaggtaattatgctaggactcacattgttagcttccttgttcaccaaatgtacaaatttagctcataatcaatatttttaatgcaaaagtttatataaggtccatactgggtaaggaaaagaaaaaataacattaaacagggacttacatcctgacaacttttgtctcatgcatcagggactctgtcctatgggatagatctacgcgtatttggggaaacacattggccagtggtccaaagtggagggtagctctgggataagaaaggctttagattcatttttcaactcttacatttactgttgacataggacatgtttcttaaactttactagcctgtaaaatcagtggagtagacaagaggagataaagtacctaaaagtgtacctagcacataggaaacaataaaaattatccaattgtgttttaagaacctattttgactatacagctatgtactttgaagtcaaagttgtttacatgtgagaaaggaaatggaccaacagaataattatagatggcaacatcctttgcctaatgaatcatttgttaaaatacattcatctaccatgtgtcagaggctggtgctgaggctatgtaagttaccaaaggaggcgaaatccatgctaccgtggagctttcaatctaacaattaatgataagcagatcacaacatggcagaatagtagatacattagaaaaaagtgtctgctcccccctacacacatattagtcatttgtaaatgtttagaatgataaacattaaaagttacattttctttaaaaatattttatttggccttacacatggaagtaattttctctggctaggcttgtatttttattatgatatgtgaagcagttaacataactcatattaacactggctggaggttttatcttcaagggcagctggtgacagggccattaaggtccacagagagaggtggaaggaagggtggtctgaatgggcaatttctcatttgttggattgatccttgattttatcagcatgctcacgttcaaaaaatcccattgtgaggtataatagatgacacctgatactaaaaatctacctaccagcctgaacagttcagaaattaatgcctctcataacaccaagagatttgataatgaagccagctcagtagaggtcaaggggaaatgatattatgtgtgttcccctatgaatcaatgtaatcctattgcatttccccagatgttcacccctggcctgtgcagctacaatgtgatctcaaagactttcataggaatcctactaaacaattttgtctaaacttgaggcactgaaaaactgtgtatggtgtaacaggtggagtttacatggcaggttcctttgtccctggagatctgatcaaatggatcctcatcccatgctccttgattgtccggagtacttccaagtgttcagagagttcttaggagaatctatagtctcatggtcacttttggttctactttatcctctaaatttgagttaccttgccattctgtgaaaggtttctctgttcttcattgccttgacccagatgtgaaatttcatcacctgctcaatttccacacctcccaaccaaccttaaaagtcatttgaatatagcagattgttctgaaaatttagcaatgtaggcgttatggggtggaggtaagggcagagccttatgtgatgacaacacaaacaccatcacatttatttaaaccatgactttctttaaattccctttccctttccttcataggaacactccaccagcagcttcttcagtttatgtcctcagtacccagcctggtcccatctctcttctgggctctgttttgtgtattcaagcatatcagtatgctttgaagaacaaaaggaccttgcttaacacaatcctcctgctcagaagaaatatgtggttttaaataattttgttattattttaacatggcaaaaattcttgggcatgctggagtgtcaggtccatgggggagaaagatgagttgaagctggacaggtaagacgcaaccaaactggggaagaattagtggcttggtgaagtctttgaagtttatacagttgaaaacatgtagtcaatgaagaagtttaagggcagtgaaaccatgattaaagctttgtttttgaaagtgactataaatgagacttgtagggaggcaacagaaattttggaagaaaaatgtttagggctttgcctgaactaaaatagtagtagtttaaatgaatatgatgggatgtgtgctatggtagatcatttttcctgtgctatgggggtaagtgttagcttctttctcctggactagtgtgttagattcttgagaagatggattgtctaattcacttacaaatttcccagaagctgtcctagggcttccatctagtatgagccctgtaaatgttatttcagtgtatggaataagatgattttctgtccacatccattaagggcagctttagtcaaaattaatacatggatatggttgttaaaaaggatttttccacattgaaatttaaatggatccaaatcttctagtctcctggggcttcactttttacccagtaagatgatgggagtcactatccctggaaatagaaggttctagctgctctactcacacacatacacacaaaaccctcagtaatcatttttacctggtattttcgtaggagggtaaaaagatgacatttttaaagctcttttctctcatctcaaccagcttctctcatctcagcttgtctgtctgtataacttgcccctggactgtggttctgagctcagcctcaggcctattggattggccagtctccaaaatcaaattctgtagcacattgtcccatagttttactgggtaaaggaagatgaagacaatgcaggaagagaacaactgactgtcgaacattattcttctcaaaatatattggtcattcccactctaggggaaaatttaaagtactttgggttacaatgaaatatcagtagcctctttttcccctaattaattctttccctgtcctttctggattctgaaaatccactggtgttcgggtataaactccgaaattgtttgtcttgcttatgagggcattctaattctctgtctaaacccctcttatctattttctacaggattgccagttaaaatacaagactccctgttaaaatttaatttcagataaaaaataatttttaagcataaggctgcagcatgggatatactcaatacaggtacacctcaaaagtattgcaagttcagttccagaccaccataataaatcaaatactgcaattaaagaaagtcacactcttttgatttatcagcacatataaaagttatatttatactatactgtcgtttattaaatgtgcaataacgttatgtgtacaaaaaataccttaattaaaacattttatttactaaaaatactaacaatcatctgagctttcagggagtcctaatctctttgctggtggaaggtcttgcctcgatgttgatggctggtgattcatcagggtggtggttgctgaaagttggggtgattacggacttttttttattttgagacagtctcgcactgtcgcccaggctgcagtgcagtggtgtgatctcggctcactgcaagccctgtctcccgggttcacgccattctcctgcctcagtctcccgagtagctgggaccacacgcgcccgccaccacgccctgctatttttttgtatttttagtagagaaggggtttcaccgtgttagccaggatggtctcaatctcctgacctcgtgatccgcccgccttggcctcccaaagtgctgggattacaggcatggccaccgtgcccggccagactgtggaaaatttttaagacaacaatgaaggtcgctacattgactgactcctcctttcgtgaaagatttctctgtagcatgtgacgccctttcgtaccatttttacccacaatagaacttctttaaaaattggggtcaatcctctcaaacccagcagctgctttatcaactaagtttatggaatatcctaaattctttgttgtcacttcaacaatggtcacagagtcttcaccagatgaagaaaccactttctttgttcatccataaaatgcaactcctcatctgttcaagttttatcaatgggattgcagacattcagtctcatcttcaggctctacccctaactctagttttgttgcagtttccaccatatctgcagttacttttccgctgaagtcttttttttttttttttttttttgagacagagtctctctctttagcccaggctggagtgcggtggtgcaatctctgctcactgcaacctccacccaccgggttcaagtgattctcctgcctcagcctcccaagtagctgggattacaggtgcccgccaccacacccagctgatttttgtatttttagtagagaaggggatttcaccatgttggccaggctggtcttgggctcctgacctcaggtgatccgcctgccccagcctctgaaagtgctgggattacaggcatgagccactgcgcctggcctccactgaagtcttgaggccctgactatcattgataagcgttagaatcaacttgcaccacaatatgtattgttttccaccttctaagtacgtggtttgtggtaccccaaaacaaccacaataataacatcaaaaatcgctgatcacagatcaccataacaggtataattttaattttaaaagttcgaaatatttcgagaaacaccaaaaggtgacatggaaaaaggaagtgtgcatatgttgtttgcaaaatggccacagtacacgtgctcaatacttggttgccacaaaccgtcaatttgtaaaaaatgcaatatctgcaaagtgaagtgcaatgaaaagaggtatgcctgtttactaaaaaaaaaaaaaagtcattgtttatctgaaattcaatttaacatggtttcctttatttctaatagctttattgagatataattcctgtcgtacaatttagcaatttgaaatgtacaatttaatagtttttagtaaaaacaaattcatatctccatggctacagtagacatttttgctactcagaaagacccctgtaggcctttgctattacctctcaatgccccatcccctgtcatccccagacataataaaacacaaatgtactttctctataaatgtgcatattttggacatgtcatataaatagaatcatgaactgtgtacacctttgtgacttgcttctttctcttagcatgaagtttcaaggttaatttctgttatagcatgtatcagtactttattatggagcaatattgcattgtatggatctactatatattatttatcatttcatcacttgatggacatttgagttatttcacattttggctattatgaataatgctgctatgagcatttgtatacaagagtttgtgcaaacatatgcttttatttctcttgggtatatatctaggagtagaattactgtactatatggtaactttaggtttagtagtttgaggaactgccaagttgttttccaaagtggctgcaccatttactttcccaccagcagtacttgagggttccaatttctctacatcttttctaataattgtcattgtttcttttttgattatggttttgatttgtatttctctgataggtaatgatggtaagcatattttaatgtccttaccggccaattttatatcttctttgggtgaatatcgattcatatccctcactctttttttaattgggttatttgccttttttcattattgaactgcaatggttatttatatatactatgtacaagttacctctcagacctatgacttgcaaaagtttctcccattctgtgggtagcattctgcacttttatttgccaaattgtatttgcttaattctataccaaaggacactcaccttacataactcaaaagtctccataaggtattttccaaacaaagaaggacttctctcactgaaaggaattttgctttcctcctggactttttggctccaagtgtggttgacttttaaaataagtttatttattttcctgattgaatttctctgtgttctcattagtcatccgattttcagcccttttctgttgaacccttttcatcaaaaacaggtactgagaaagaagatcttgttttcccttaaagttttcccttaaagttgttactgagttaaaatgtagagcctgaattgtgaagtggatgataagtggtcttcacaattaccctggaacatctccttgtacatatctaacaaacacactcttttctcgtaagaaccaaaacaagaggcacctttgtgattatctattcaagacaccttataaaatatatctcatttgtatcatctccaatagtaacccacgagccatctaatagcaatttcagaatgaataaaacaaaaaatagcaatatggttgtgacctgctttaaagatagtagtgtacttatattacaggaaaacaattgaatgggactacttaaagggtaatttatgtaaaaatatataccattatatgagatacatagtaggtgctgaataacgttagtttcataattgttttccttattcagtatttaaatttaaacccctaaaaataattcactggggtatcaaattatatgcctacatttgtaaactggaatcattcagtaactgcaaaatattaagtatctataaaaaggcctaggcattgtattagagacttaactcataatttttcatttatttaccataattctctgttagatatatataatcacttttaggttacatatatattcactgagttccagtaacatattcaaattcatataagtggtaatataaaatctgctcttcaaatatagagcagtctttcctgaaaactcatgttctttttaatatagaacatttcatttcaaatcctatatattttacaaatgtttctttttccagagatcttctctgatcactctgagtggaagtaatttgttctataatggacctccagagtaatttcactgggaccctcctatggtacttagcattttctacatttttatatttattggtttctcagtgttttcgctgtaattttatttcttctcccatcatctctccttctatattcacagtgatagatctttcactacaatgtgtttactaatatgttagaaagagccaataagtgatatgcagcagtgatccccaacctattcttatcatgacaaacatagacaattaaggcactgaaattctacttagattaaaggtggattagcttatctcgatcaataacaaaaaggatgggcttgaaaatttctaaaaagcataacaaatctaaaaagtttgtaaggaattatcattacaaaactgatgagagagagaggtacctaaaaaagtaagtagagcatagaagatgcttttactctggatagaagatgcttttactctggaaaaaaaaatccatctagccaaattttaactttgtttttctaactgcctaaaatgtgtgagaggtcaaactccagaacacatccaaaacttgagagtttaacaggaaatcctcctaacgttgagggggtatcccaaatgaataatcctggagaagagatttttaaaaatcagctttcgtattcatttcaaacccatattgacatcaattagaagttcacaaactatgaatttatgataacttttgagcagaccagagggactcctaggaaccttaaaacaaaaagaaacagtttgtaaagttgtatctttatcttaagcccaaaattattgctgcagattttttttctagggtgaggaacatcatgcaataatgataaagcatatcaaatataatcaaacctacagaaaatgaggtaaaatgagttagaaaccagaaaaaaacagacagcaagaaatagaactagaaagaatttcatatatgggaattatcagagacagatcataaaacagccatgattactacttttatgaaataaaaggtgaattgagaacatattccaaaaacagaaacctataaaaagtggcagatcaaattaaaaacttacaaaatacaacttgtagaaatcaagaatacaataactgataaataactaaatggatgaattaaatggcagattagatgtaactaaagagacagccaggaagaaagatcagggaaattatctggaaataagattgcagagaagaaaggataaaactatgcagtaaatttagttgactgggtggacacagtctaagttagcgagctatgaaatggaagcaaagccttctgattccctgttactttctgggtgttagaataaattgctttactttatacttcaatataatttgctataatcactaaaggaatataaataggtaaattaacttcagaaattatgtcacaaaaattgcaggataaaaaatgctgcataccttaaatatacacaataaaatttattttaaaaattaatgaaaatattaataaaaatagaatagtggataaaataataagaaaaattaaaattgaaagtacaaatttgaaaggagaacacagggtggttgaaaaaatgaaatgtatttacaatgaaattaaatgcaaattgattaaatgctctagttaaaaacagattatcagattgaacatgtatattctgtttataagatatatgtgttatttagatgtacctaaagcataaagataatgaaagaataaaaatgaaaatacgtacaaatagtaatcaaaagtacaaataataatcaaaagaaaggtgtagctataaatataacaaaaattgtcttttagccacaaagcattactggtgataaagaggttcattttataatcatgaaggtttgagtcctccaatcctaaatttatattcacctggtaacagttttaagatatataaagtaaaaactgataagaaagaaacaaatattgaccaaaattaaagaaactgagaaaacaaagagtaggaatgagttagaagaattgaacaataaaataccatacataccaaacaactgaaaaacacaaattacttttaggcatatttgtatccattatggaacattcacaaaatttgatcaagtgctaggtgtggtcatgtaaatttatatcaccattttggaaatgttggataatatctattgatagtatgtttgaagttacatactcctttgaaccagcaatctcacatcaagaaaaatactcttgagaatatcatgaaattgtcttttagggcatatattcaggaatgtttcataccaagactatttataatagctacaaactggaaatacccaaaatgctaccaataggagcatggataaaaaaactgtattgtattaccaaaaaaaaaattctatacaacaaatggagaaaatacaacatctacagatgtcaacttgaatgaatcatgccatcaaatcttgagtaaatcaagaaacattccaaatgatgcttaaaatgtaattccatgtatgtaaaattaaaaaaaaaaatattagtaaatataattgtttagaactgtgtacataaatagtaaactacaattttaaaaaatgtgcattacaatggtaaagatagtggctgtttgcacacagagtgggaaggaattatagagggcttctgacatgttggctgtgttctgtttttcagcctggatgatctaaacatgtatattttccacgctgttctctttgtaagttatatttgacaaataagaagatttttaaaaagccaatttgaaactattttagggttcataggtataaaagggagaagtagctttcagccaaaagggagtctccagttttacctgactgccttaagagccttggaggagtcaatgtttatcttctctaacccttccagggaggtcattatgctatctcctactttgtagtccccagatcaaggaaatttaaaatctcactctacttgatcttaatgagctcttttgtttctttacctccctctctccgtctctcctttctgtttacaaaaatgacaggttttatggtccctgtggtagcagttttatacagtcttataacaaattgtctcaacctagatgctattgacatttggactagataatgctttggtgtgtttgtagtgagggctgggggtgggggtggggctggcttatacattgttggatgttttgcagcatctctggtctctacccctagatgtctgtggcacaccctcctttcccccagccttccttcccacttgtgacaacaataatatctcaaaatattgctaaatttcacttaggggacaaaacagcactgggctaggaacaactgacctacagctatgggcaaaaggagtctttaacaactattgttggatcagtaggtatacattcaggcttcacatataggtgcaggtttaagcttggtaagagaggacatgaggaggtatagctaaatatatagaggtacgctatattgaagggaagttacatctgctggctctaaatggtgaaaattgagtggaagttttgatcagatgaatgacaacaggaaatttttaaaaagcccaatcattaaagtgatttgcaaatacattaaggtagggatctcccatcatggttagtattctagcagaagctgcattaattcaggaatattgaagacattatccctggatatttggacaattcagagttctggtttccaaggtctcctctactgtcaggaggatgacctttaaataaaagactcctggacttatcagggacagtgtcttgtaaaaagccagtgtctttctctgctgtctcggagacagagtttgctattaaggatttttcattgcttttttgattgcttgtggccttcaaacagtgttgagtaaaaatacattttcatttttccagcatttctgagccaggcaattgctatttagtttagaaaagaagattggcttttttctattagtgagtgtaaaaaaaaagtattgccagttgcagaaaaaaatccatagaaagactctctctcatcatcatcatgtatatttgactaaatgtttcctcttttttagggggagaccacatgacctggatgacctaggatagccctggttatccttctgcctcgcatcctgtctagtttagcacttgttctaggtttttcacttgtaataaaattgtcattaataaccatgacatttaaataatctggaatgcttttggtagactgcgactttgacttttagcttccaatatagtcttacctaagagcaagatttttaacatgcgcttagaagtcgcacatctttcttttcatgattctttccaaatgcatcatagctaaatctctctttgtaaggtagcaggcagatgtttgctgacataacaaagtcttctcaaatgcgactaaggactgctaactctgtggcttcaggtgtctgtggtagaggcatcgggcttgttgcccccagcaaccacttggtgtaccagccagttctatgacctgtgctaaacctgcctggtgcaggaagatacagtacagcaactgggagaggagttagagtaatacatggggcattactggttaggaatttgtagaatatgtgagggtaataaaagttcaggcttccagttgtagaatgcctagaatagtataaatgctatcactacagtggttgtgttatttattgtatggaataaatctacaactgtttatttagtttgttgtttggcaatgcttatttttaaataaacctttttagcagcagtagctcaaataaacagaagtgcatgcttagagaatttccagtagctaagaaagtcaatgataaacatgtacttgagcaaaatgtttctctacatttagcatcctccatgggaactgtagtgaaatcactgaccacacaaaagccagaagacctaaatctgctaaagaaacaccagcatctacttaaaaaaatcacttgttattttaggaaactgtgcctaaggatgacaaattaatacagctctgaagtgtgactatcaaataatagttcttttaaattaacttcactcattttctattgcaagtattgttatccatatacaaaaaaaaagtcaaactgaagtagttgcaaatgtcttggatttattaacagatatctttgcaaacagttaaatgatgccagttttatatcgatgttatcagatggtttaaagagaaagccagttaaggccaatatgggaatttcttctagttcatggaatcaaactaaaagtttagggagttcattccaacgtaggtaatgcatctcatggtaatttcaacgctacaagaaatttagttataagagttcaaaatgaatattaaagagaaactacttgtttctttttcacagtttaatacacatacaatttttgaatgattcttgtgtcatgataaaggcaatgttcttattaaattatggaagccatggagcagaaatgtagtaacaatagcctgtgtacaaacataattcataactgggtccaaaaagccttcaataatctaccaataaaaagaaaagctatagttgtcaaaatttacaaatatgtttaataaaagaactttgaagaaaaactaatgcttattattaaatatatattttagcctggtggccctcgtttctctctacaaggcttatccttaattgtttttaaaaatgttgagcttttacataaatacttggcaaatcaatgttaagtgttccggaatcatatataactttttttgggaaactcatttctaagcattctcttaccaaactcagttgggaaattttaataaaattatgcattccaaagacatgccttcttgaaggtagagttcccagaaagataagacattaaaaattatccctgcaaaaataaaggaaagactgaatgaattaaacatgaatccaaagtttggacaacattgaattttagaattccattttggcattttagaatatcttgactcactgaaaaattattaaaaaaaagtttttcctggagctttgtttttaatcgaatgagtttatattgtatattagaatgacatcaatttgagaaggcctagagttttgcagtatcctaatttagtgaaatattttaaagaatgataaaaggcaatttatttgttgaattgcatcttgttaaaattattaacaaagaaaggtactgtaaattgaagtaaaaatgtatttatgaaaatatttggactgaaacatttgcatgtttcaatatgaaaagaaaaaagagctgagaatagagtgcacttagaaaaatagattccaaattgttgcaacaattttagtgaaagtattttctcaattaaagacattatggtctatacaataatgtaaatgaagaataaatttaaagtattaaaaatatgaaatttattatacataaaatgcgagtccatacaggtttacaggtaattaaaaataatgccatcttttcaagattccttctcccattaccaatgacataatattagagacagatttaaattaaaagttgattaacatatatgactatctatgaaagatgattagttcgatgatgttattttttacatgttcaaatgacaaaacattttttgttattttgcctttattgctattatataatgagaggagatatatattgtttatatattttagaaataattttacttttaacattgtttttgaatagaaatattttataatctaccaacataagccaatttattaattaataaacagttatttttaaaaatgtgatacattatttttgacaccccatttcattctccaaaatatcccagtttacacattaaatcacgtgttcactcatctgtgataataatgacagagtgttctgtgaatacacacatacacacagaggggcacatgtactctcaacaaataataggattttttaaaataacgtattttcaccttcacctaatcttagtcaacagattctaagtgcttcttttctttaaatttttattttgtaatgttaagaacatttaacatgatacctaccctcttagtatatttctaaatgttgactagtggtacactgttgtacagcagttctctagagcttattcttcttgcttattgattactaatttctcatttcctccttctcctagcccctggaaaccactatttcacaattcaattctataaatttgattattctttttttatgaatatataacatttgttcatatttaaggagtatatgtgatactttgatataaggatacaatgggcaaggatcaaatcactgtaattaggatatccatcgcctgaagcatttatcatttctttgtattaggaacattattctactcttttagttattttgaaatatacaataaattattgttaactaatgttgccctattatgctaccaaacactagctcttgtttcttctatctgactatatgtttgtaaccattttagacacctcatataagtgaaatcatgcagtgtttgtctttctgacttacttcacttagcataaggttcatccaagttatggcatgttgcagatttctttcttaaggttgaatagtaatccattgtactatatatatagtacaatacatatatagtactatacaatggattactatatatctattactatacaatggattactatatatatagtactctctatatatagtactatatacatctatatgtatatagtactatacatatagtactatatatgtatatgtatatagtactatatatgtatatatgtatatagtactatatatgtatatatgtatatagtactatatagagagagtactatatatatatgcatatatgtatatatctctcatttttttaatctatgaaaatttaagttatttccccctcttgactattgtgaatagtgttgcaatgcacatagaagtgctactatctcttcaagatcctgatctcagtacttttggataaaatcccagtagtagagttgccagattatggtagtcctattttttcttttttgagaaacctccaaattttttccattgatgccgcaccactttgcatttccatgaacggtatgcaagggttccaatttccaatttttctccttccttgccaacacatgttattttctggggttttgtttgctctttttttttttaataatggctaccctaacaggtataaaatgacatttcgctgtgtttttgatttgttattctctaatgattagaatgttgaacatttttacatatacctgttggctatttgtatatcttttttttttttcgagaaatgtatatcaagaccttagctcattcctgagttggcttattgtttgtttgttttctattgagatgtaggaattccttacatgtttgggggtctaacatatatggtttgcaaataattttctcccattctgtaggttgacttttcattgctgatcatttcttttgctgtactggagcttcatagtttgatgtaataccacttgtttgctttttattacctgtgcttttggtattatatctgtgaaaatactggcaaaaacaatgtcatgaagtatttcccctaagttttcttttagaagttttacagtttcagacctcaaatttatgttgataatccgttttgattttttttttgcatatggtataagataaaggtccaatttccttcttttgcatgggaattatccattttttccaacactatttgttaaaaagaatgtatttctctttcaacaaagtaggaatagaagaaaattacttcaacataatgaaggccatatatgaaaagtttacagctaccattatactcaatggtgaaaaacagaaaaagcttttcctctatgatcaggaccaaagtaaggatacgtatcatcaccatttctatacaacaaagaggagaagtcttaaaaagagcacctaggacagacaaagaaatgaaaggcatccaaacaggaagggaagatgtaaaattgtgcctgttgcagacaacatgatcttatatatggaaaaccctgaaggctccatttaaaacaataagaagaacaacaacaaaatgttagaactaataaatgaattcagcaaagttgtaagataaaaaaccatatccaaaaattagttgcatttctatagactaacaacaaactatctgaaaagaaaattaggaaaacaatcccaaatattgtaaaaccatttacaatagcacaaaaataataaaatcttaggaataaacttaactaagaaggtaaattacttgtatatttaaaactataaaaatcatgaattaaacgagacacacagaaatggaaaggtattttgttttcatggaaaacaatattgttaagacatccatactactacccaaagcaatctacaaattcaatgcaatctgcatcaaaatctcagtggtattttctaccagtaatagaaaaatccattttgttttttttttttgagacagagtatcgctgtattgcccaggctggagggcagtgatgcacaatcttggctcgctgcaacctccgcgctcccgggttgaagctattctcctgcctcagcttccgaactagctgagactacaggcacatgccactacacctggctaatttttatatttttagtagaagcagggtttcaccatattggccaggctggtctccaattcctgacctcaggtgatccacccacctcagcctcccaaagtgctgggattacaggtgtgagccactgggcccggccagaaaaaattttaaaatgcatatggaatcacacaaaataatcaaatagccaaatcaatcttgagaaaaaagaacaaagccagaggcatcacactttctgatttcaaaatattttacaaaactacagtaatcaaaagagtgtggtactgacataatgacatgtaggccaatgaaacagaacagagagcccagaaataaatccatgtatatgtagttgactgatctgggacaagaatgctaaaaatacacaatggagaaaggatagtctcttcaaatgtcttccatcattaatttattcactcaaaaatatacattgaggccaggcacagtggctcacacctgtaatcccagcactttgggaggccaagactggtggatcacctgaggtcaggagttcaagaccagcctagccaacatgctgaaaccctgtcactactaaaaatgcaccaggcatggtggtgcgcctctgtaatcccagctactctggaggcttaggtgggagaactacttgaacccaggaggtggaggctgcagtgtgctgagatcatgccactgcactccagcctggatgacagagagagagagagagagttctgagaaggtcccacacctcatggaaaacttagccatacgagatacagtccttatatcaaagcataatctagtgaggaaaattatatacacacactatatatttgcacacaaatatatatgtaatttaatcacagtgggctaactgtcatgtcggaaatctgtgctggatgtagatattacacaggtaatagaattagcccagaacactttatttacggagcatctcatggaactggagtgctaccaaacacatttttggaaatcccactctctatagaagaaaatatttaaagggtttttggtaagtgaacataaatcagaattttctattttgagatatataggagttggattggaaggttgtagaatctctgagttgtccaaataaatttagatgactgccgctagagaaaaactgcctttgtcgggaaagaaatgataaagggctggaattgttttacatttagtcacactaatagggatgcagagagcctgagaacctgcatatgagagatcacagattttgaaaagagccagagcttgggatgattgcccatataaaaatgcttaaatgtcttaaacataatttgagtggaattatttatatttcaagattaacatactgcttgatacaagttgcctgcacattttcctttaagtaatgggctaatgggctctgcgtctctttgcctaaattaaatgtagtttgcaacaattcaaaatgcaaatattttttaaagtagtctttttttttttttttttgactggcattcacaaaagctacagcactcttgtattagcaggtaaaatctggaccttatttcatcctggacaatccttaagctgagatattcgccaaatggcattatatctgctttgtaaatgttgatctcaggctccacttattttagccgctgggtgtggtttgtcccagagtctcctgtgagcttattttgctaagcaatcagttacactctaataattgatcagcctttctgtgttctttacaaagcagacctatcactcagcaagattttttaacactattttcatgaagtctggatctactgaggatttgatggattcaagaagacaaactaaatgactttttggctacctcaggatagacaggggacaagaagaaagcaaaaagcaaaaaaggaaaacaagaatcaaatcattttccattagacatgaatggctcaaactagtgctctctcccttataagaattaaatttgttttactcgcatagagttaggggtcagaatttctctattttacaaacagcatattttcccttttgcttttgcactttaagaacttatatgtgggggatggggaattgaggtgtctgatttgttagttgaaggttatggtaattttttttgtttgctcgtactcattttacaagtggttaaaactttggtgatcgacatgaagacccattttcttctcttgcttggactcagagataacagatttgtgcttaattcccagccaagaaattggatggaatgaattaccatgttgtagtaaagactttgtaatctggagaccttgtgattattaattcagaggggattcatcagggtctacctctgttggctgattaatcagaggatgacatcaaggtaactgggatattgtttgggcctcaagggttcttatagtgcaaattattaaataatttttattattaaatatttttattattaaattgattttattattaaattattagatgcactaaatgaagaatgaggatttattaacttattattaaagatattctgaccaaaaaagataagttgacatgaataagcaagcactctaaacttggagaaagtaggtttaggaaaaacttgaggacccaagactgattgacagcatgacactgaaaatcttctgagtttctggttactcactgtaaaatgcatgtaatgttcacctcatgggtttttgtgaaaatttagtgatatgcagaatctagacgtggtctgtaagctacacttgcaattaaatataaaatattattatttttatttaagttataattgccttttgaagaatttccttaggtcaattcatttacaaatggtaacatttaaattatgatatgccttgcctacattttcatggaatgaacagggtattaaaaaatgttctacatatcaaaccctccaaaacaaattagcaagtatgatcaagtattatgtagatggttaggggcttgcaggacaatggtgactttcgcacctttgtttttattgagttgtaaattgggaccccttttgtttattacatgatcatccatcttagtaactggccttgccttgcacctttaatagagtttgataagagtcagttagatttataagcaatgactttacacctaagggtgggatatgaaactcctggactattagtgagcaaaagatattttaaattacataaaagtgttatacagccttcaagtaagaaaataaacatttctaggttattcaaacattttttaacataatttttgagggggtataattttagatttacaaaactttataccttcaatttttgtttttaaaataatggtattaatatatcctatggctttggacaaatagatttaccacttgacctcagtttctggttccataaatcaaggggtttagactgagtgagtatgaaaatctcttctaattagaacttcgttgaccccattattaatagttatttaatgaactgatgttggaaaatgagaagcagcagtgttgctgcctcagatttgggcagggttctcttgatgttggcagtgttgttaatatggcaacacattccctgttcattcatataggtcaccaggaatttatgaggaaagaatgcaaattttttgaggaccaagtgagttccagagaccttcaaacaatgagactaataatagtgaacagtcattgagaggtctctgtgccccagatgtgtaccttacctcatttgatagtcacaacattctagcaaaagctcagtttatcaccctacattttcaattgaaattaaaccgggttaagtgattttcccaggcagaaagtgactgagccagaatttgaatctgtagtgtcctggattcagaatgtgaactattcacctttacaacattctgcctatttctagctgcagtttctatcctaaataaatcatttctgattgtattatatcttgattacacatttcaactagaaatttagttaaacacaaaacaaaacaaaacagcaactcagtaattaagaccagagttctgtctgcttttccttttaaaatatcttaccatgatataatcagactctaatgctacatggttattaaggaaatttttctgttatcagtttttttgtgtgtgtaggagtacttgattgttccatttattgcaatctatgttccatacctaagatggcaaaaccctaactctacaacagtagccaagcagacactctgaaaagtacgaaatgaatttgagattctacaaagaatctccacattttttttcaccagaaaaaaaaaattgttttctcacaaggttctgctaacagaaatatctgagataacagaatcagtaaactattaccttcgaggccaaaatacattctaaataagttatgttactgttgtccaaaccatgtattaataggtagaggaactatactctaggtaagtgggaagaaggatcaccaaacattgaagtttggagggcagcaggcagatggggaagaggttgtctctacagcctcagaagtgcaatttatcttcatgacatcagttagatcttcattgctcaggtcccaaaccttgacctaataccctgagagggcttcatcccgcaagattggatttactctatttacaagagaaactggtgtataattcacagcaacttaatacatttgcaattgaaactatagtgatacagccaactggacagctcattgtctccatttagagcaatagttcatacctgtaacactgcctgaaaagagcttccacagacaggaaacactcccggtaatgaagaatgtctgcatggactgcatgataagggttttgtgcaattgttaaagcatgagctctaactttacctcttctgtcttaaggattctttaacatagcaccgtggctttacccctgctacagagaattctataggaaaatcccattgtaatcaaaggattgctttgtgattattgagatgctaacagatgattttgtcatttatttgtattttatgtaatcagctaatgatatttacatacatctttctctatgtctactgtgccagggacatgaatgctaagtcaggacaaccatacctctgaggacagtccttggatgatatctgcaaaaattgcctctgtaattattatgatttttttcaatctaagatccattgttaaccagctcccatcttgactgccgtttttttttgtttttgtttttgtttttgtttttaatggagtctcgctttgtcccccaggctggagtgcagtggcgggatctcgtctcattgcaacctccacctcctgggttcaagcaattgtctgcctcagcctcccgagtagctgggattacaggtgcttgccaccacggccagctaatttttttgtattttagtagagacagggtttcaccatcttgaccaggctggtcttgagctcctgccctcgtgatccacccaccttggcctcgcaaagtgctgggattacaggcgtgagccaccgcacccagccgtttactgccgtttttttatattaatataatcaactacttttgactaagtcaggtaactggtctccctttgtagagaaactttgaaaacatcttttctcatttattttgctcttactccaattttgctctaagaagacaaacacattttccttattttgaacttggcagtaggagaagtggactgctgttgctgctttgtttttttcagcttgctattttccatagccgtgctgtaattaataatcttttgtagtcaatagtttctaactattcagttatcccagttatccatgggattcttaaaaaaaaaaaaattgtcccaatatgctttagaactgaactgcacttcctgcctgcctgtctgccttccagtgttgtgcttttccatctctctctcccttcttctgttttctcttctttctctttttttcccttcctaagttcttcccttccttctttctttgagaataattcaggccaaaagatgttttggggggtcagacaaattaggtagtgagtgtgtatgtgtgcatgtgtgagtgtgtgtaaagatgtgagtggggatgtgtttgtgtgtgtgtgtgaaagggtgtgagtgtgagtttgtgaatgttggatggcaggcagacagtatgcagcctggagtgttggagcccaggtggagtaaggggacatccacccagggaagggcggagagggaagtagtcagttgccagcaagatgagatggaaaagtgatggagggattaatccaatatataaagatatggagtataatggaagccagttttctcactattggagaaaagattgacagcatatggaaatagaaaacattagaataagagttataattttggcttgagattgaaggtatcagtgtaaatcacaattaaactgaaagatacattagatatgttgacgttctaacccccagtacctcaggatgtgactatctttagagataaggcctttaaagatgttttaaggttaagtgaggtcattaaggtgtgtcctaatccaatatgactgatgtccttgtaagaggaaatttgaacacgcaaagagagatggcgggtacacatgtgcagaagaaaggacttctgcaagccaaggagtgaatttccaggaaaatcaaccctgctgtcaccttgatctcagacttccagccttcagatccatgagcaaataaatttctattctttaagctactcagtcactggtattttcttaggatagccctagcaaactaatacttattggtagatataaatatgaaaataaaaatgaatgtcaatatgagtagaaataaatttagatataaatacgcatgcatatacgtatatgtatatctgtatgtaaatatatatactcatcttgtagcaggacgatccacagacaagaacccctcggacaccgagttgtggaaggaaaggcctttattcagctgggagcatcggcgggctcacgtctccaaaaactgagctccccgagtgagcaattcctgtcccttttaagggctcacaactctaagggggtccatgtgagagggtcgtgatcgattgagcaagcagggggtacgtgactgggggctgcatgcactggtaatcagaacagaacagaacaggacagggattttcacagtgcttttccatacaatgtctggaatctatagataacataaccagttaggtcaggggtccatctttaactaccagacccagggagtggctccgggctgtctgcctgtggatttcatttatgccttttagtttttacttcttctttctttggaggcagaaattgggcataagacaatatgaggggtggtctccgcccttaatctatattgcctcgctctgtccactaaagagggtctgggaactgcagtccaccgataccagtaagaaaaatttgtgttctaaatacctggttcttggttgctaaatgctgttccacactaaaaggaaccagactttttaaaaacattttactttaagttctgggatgcatgtgctgagcatgcaggtttgttatataggtatacatgtgccatggtggtgtgctgcacctatcaacccgtcatctagcttttaagccccgcatgcattaggtatttgtcctaatgctctccctcccctttccctctacccactgacaggccccagtgtgtggtgttcccctctctgtgtccatgtgttctcatttttcaactcccacttatgaatgagaacatgtggtgtttggtgttctgttcctgtattagtttgctgaggatgatggtttccagcttcatccatgtccctgcaaaggaaccagactttttagagaaatagctgattactagacctgggcagggaaaattcaagatgtagttggaacattttattttgtcaaaaagaaaagaaatgatcaaagaattatagggacatatagaggagagtcaatttatcaggcatcccactagaaaaccttgagattttcacccagtaagtgaaacaagataaatcttgaatataaactgatagaaattaataaatgaacaaatcaaatggtaaggaatcacatatttacatcatttcaaggtaatatcctgtaaaatatttatcaatcacaaataataaagaagtgactaactgtactgtaagaaatcttggcagatatgactttagtcaagtgctcaaagtgaacatcataagtaatggaacaaactaaatcttggaacagctgatagaataaaacaaggaaaacagagcatcactcttgtggcagtcttgccaaaggcataaaagctgaatataatcctgtgaacacattagacaaacccaaattgaggaaatactataatataatcgggcaatcttcgtaagtgtcaggaaagattgggaaatttccaggttgaaggagactagtattgacatgacaggtaaatataattgtgatgcatgatcttcatttagatcttttttttttttttgagaacgagttttgctcttgtctcccagactggagcacaatggcaagatcttggcacactgcaacctccacctcccgggttcaagcagttctcctgcctcaacctcccgagcagctgggattacagggacatgccaccatacccagctaatttttgtatttttagtagagacagggtttcaccatgttggccaggctggtcttgaactcctgacctcaggtggtccacccgactcagcctcccaaaatactgggattacaggcgggagccaccgtgcccagcctagatcattttttactataaagctgattattgggataactggcaaaacttagatgtggtctgtgggttacataatagtaatatattcatattaatgccctaattttgtcatcattttgtagaaataatgcaataaaacattcagggctgatggggcatcatgtcaacacacctcaaatgattcaggaaaaaaatataaattttgtactatttttgtaaattcaagatgaaaaaataagtattgctgttacaagtaatttatctgtccatctgtccatgtatctatccaccaatgtctttatccatctcctattaaagaaaactaaaatcagaaactttttttgaactcatattaattcttatattgaatttacaagtttatggagtctgttacctgagagttagaaaagataaaactcaggttccactgttcgtccagggactgtgatgagtattttcatctatattaccttatttacatttataatagttccaagaggtaagtttttgtatatgcattttacagagtaagaggatgaggctctgagaatttgaatggattattcaaggattcattcgttcagctcctgcacatcagggctcagaattcagtgccttctgccgcctggagttctttctgataaatcatggtaacttcatctggcttagggggataagcttcagtcaggcagtaagattctctggagcctttttgcagtgctagggatatgacaactaagcaaagacttctgagaaattgtcaagggagtccataaatttcagtggaagtagacctaggttagccatttaataatgagagtttttgccttggttttgtcagttattttttcttgtgactatttaagagactcagagacccagttgctttatccctaaaatgggcacaacttcctggcctgtaatttcattaggtggtttaaagaatacatgagatgatgagttaaaagtgatttgcacttctaaaggtgctatattgacctagcatgatgctgatttgtatttgggtatgagttgtccttataattagggtagaggttagaacaaaggaatacattctccctcatagatgagtcaatccataatctccaggaacttgtttttttgttgttgttttttgtttttgtttttgttttttcccctaaaagtttcaggctgtggtaatgcagtagagtgattgcataattgattccaatctttcattgtcctcaatccatttcccctgccctacaactatgtaacatcctcccaatcagactctgaactcaaccacatgacttgatttagccaatgggatattaacatatgtgacacaatcagaggcttgaagtcttgctgattgggtttgttctcacttgtcctcttctttaccctgaaaggaaatgctcagataagcaggtggtttcagcaggagggtgagagacatggaggagggctagtttgctctacacatccattgccttcctagatgagttgacagagagctgatctgtacacatacttagcgcacctaggagctgacaaaaccatctaatttactacccacagatagctcagttcaataaacacttattattgatagctcctaaacaatacattgtgattttagtaaggcatgcatatatactatgataaagtaaaaagcaaagtttctgtaactttaacatgaaaccaggagcttcaatattactttcgtacctaccagcttccattttcagcattaccttcagatgcccctatatctgcagcaatcgaggactgtatttcagaaataattaatttaggaaataaaacagcaactacttaagagatgctgatattgaacttccacctgaaatctatcccattgcacatatatctagggctcagtatagaaagaaagaactaagtatgactgtgacctagaatactccttggaaatggaaatagttaaatcatctaggagcttttcctctggaattatgggagctggtttcccttttctttttggatgggtgggaggaaaagtttgatttgaaatataaacctcttttagtgtaattattttataatgtcttatttgaaacaatatatacacagtcatatttcttaaattattattataattcaaataagtaaggatattgtaaatctcccttccaaatttttaaagtaatcttgctaatagcatttttttttttttttttttgagacggagtctctctctgtcgcccaggctggagtgcagtggcgcgatctcggctcactgaaagctcagcctcccgggttcacgccattctccggcctcagcctcccaagtagctggtactataggcacccgccaccacgcctggctaatttctttttgtatttttagtagagatggggtttcaccgtgttagccaagatggtctcgatctcctgacctcgtgatccgcccgcctcggcctcccaaagtgctgggattacaggcgtgagccaccgtgcccagccgccaataacactttttaaactcctgtgcatcatctgtgtaatgctatctttcttgcagcataacagacgtatttttattgatcgtaatatataatatcaactcttttttttttttttttttttttgagatggagtctggcactgtcgcccaggctggagtgcagtggcacaatctaggctcactgcaagctcctcctcccgggttcacgccattctcctgcctcagcctccagagtagctgggacgacaggcgccggccaccatgcccggctaatttcagtagagaccgggtgttagccaggatagtctcgatctcctgacctcgtgatccgaccacctcagcctcccaaagtgctgggattacaggcgtgagccactgcggctggcttataatgtcaacttttaaacttcattcctctgtaatggattttgcatggccaccttgcaggtagaatcagaaatgttgcagtcctcttttgaaagtgcataacaaaatcttgttttaagagaacaggtgctagggcttgtattctaaccaaactccagttcttagcaactgcattctaactgcagaattactcatacaatttgaactacactagatttctttgttcatctcttcttaattaataattgcaatgttagggaaatgcaaaagttgcataataaataccgagatagtttttttttaaatgatatatgtagtaaacatagtttaacttaaaaacaacatggagctggcatcgtcattaacaagctgtgtgattttgtacgtgttactttacttctccaaccattgccttctttatatgtgttaatatggaaaaatgtctatgatatatgttcagtaaaaaaagctgaaacaattgtatttatgctctaatcctgtgataatatagatgggattttaattatgcaagttcctaaagttagaaatacgtgtataaaagtgagtttttataacaaaagtattcctagggtactaaatacttataaaattagtctccacccaatcatccatcttcacttaacttttccactcatatatcatgcatgtgtaaatcatctctaactgatttctaaatgttacattccacaaaacaacataaatgcagggcaaatcaaacacacaatggaattgcatatcatgtactacatgcaatatttcatggatctctcatagtaagattgaagaattactcaaatcccacccaaaactgttgcccatcaattactgtatttgaaaaatagggggaaaaaacaaagaagaaagggaggaaggtagagaaggagggaagaagacaacatgatgatgatagagttggcaccgcaaaatattttctaaaaatataccaaaagattaagcaatctatgcaatcataaaatttgtagagaaaaattactcaaaagtgtcagcacatgagccatattttattcattcgtaaaattattatatggaacaattaaacctaagttttattaaatgtaaaacgatatactatctacatattgagttttatatttctaattttgttctttttaaaataaaataatgctacataatttaattttatccactttaaatggtctaacttcattcattttcagatacagaagatcttctaggtcttctgtatagaaatatatacacaccatctgcacacatacacacatatgtacaaatacatctatctatatatgtatgtatatatgtatatatattccagtatatacatacatatgtgtgtatatatattccatgtatagtgtgtatatatgtatgtatatatgtatatatattccagtatatacatatgtgtatatatatattccatatatagtgtgtatatgtatagacacacatatacatgcatatatgtatatacactgatgtatatatacattgatgtatatatgtatgtatatatgtacatatacatatatgtgtgtgtgtgtatatatatatatttatgcacacacatatatattccagttttcaaatggagccaaaacactggatttgctggctttttcccattcaagtctagaatagactccagttctccctcagctccaacatggatgtttttgaacagtcagggaagttatagatccatggtcagtatttcacagggcacttgggatatctagctatgtttaagtatgtacaattagtaacaagaggagataaagcagaagaaactaatggggttgcactttgagtgaacttttaataattcagattgaaagatagacttattttcaaattggcctgtgatatgaatagtgtggtacaggaaagaagatcagaggataacctagaacctggaggacaaaaaaagaagtgactcatgccacgtttttttttttttttttttaaatcatggaaggaattctaggagataataataaaaccacacccagtaagatatataactggttatgaaattcttccaaattatatattcaaggttatatatttttgtctagtaaaattgaccaagcaacaagtgcccattttgctttgtgagagaaaattgcatcaatttttggataccttaaaagacctcattaaaagagactattgaaagattattataaatttctagccacaacaagggaactttccttgactaattaaggcaataatctcgtgccagaagggcctggacaagggttatttctttccgggttgtcttctggttcaatggcataatagattacaacaattgactgatctatctcattgatacttattgtctgaataatcatggccttgttacctatagcttcaacaatagcaataataagacaaacaaaatacacaaatacattctgtctctcacacacacacacacacacacacacacacacacacacgcacacgcacaatccagccttggaaatttaagaacttgtccagtcgggcaaggcaggacctggaaaaacagaaccaaatagatgtgttcaggaggaagtccagtgaaacaggcaagtggataagaggcaaagacatagacagcgtacagttcaggcaggtaataagcatgaagaaggagacagcagtaaaacataaataaattaattaattaattaaaacaaaaagcatcctggaacccaaaagcacaggcagaaagcagaaaagaggtatctaagaagcaatggtctggaatccaggcagaaggcgtgtggtcagcaccagagagcacaatcagcggacaatcatgctttgggccatttaaaagaaatacatttaaattttacacatgcagctcttggatggcattgggtgagtgcaagacaaagccctcacactgggcaacctgtcaacaacatggaacagtggaactggaactgactttggagtccaacagtgctgagctcataccttcactccagcatttacaagttgtagatgagtacaacttgtacagttaacctcctcatctgtaaactgactaataacatctctttgctcatttgaagattagacaaagtaatatacatgtgtaaaacacaaaggatagtgctcagcatataacaagtgtttatagtttatgaattttctttagagctagggaaaaaaatgagtttaagagcaggttaaccacaagaaatttatgactgaattcaatgtgcatcataaaatacattaaattcttgttgcccatacttacagagttgaagttagagctgattctagcagacaatgggtgagacacgaaatggtttcaagtaatcctgggtctgcacagggaggtgggaaatgcagagggtagggagccagacaggagagttggttttatgcagaaaatgccagcagattgattttctaaagtaagagatttttaattcaattccctttgcacctcttcctctgcctgagattctgctatattacactctaaaatagctattatcactatctgttacaaagctgatgcagaataattgagcatgtccctggagaaattacacaaacaaattccttaattctgcagaattatgcagggcccggaggggattcctcatgctcccctaccttctcatcaatgttggataattagttttctgtctgaggcatatttataacatcagtggagttatcagtggtcaataaggtgatgcttgggtgccaataattgggaaacttgacattttccaattagatgaatttctcagtgttgattgaaagatccaataccggtcaccattttctgcattattttctgggtagctcagtgggacacactgagagagtatggattagaagagacaggggccagagaagggggttggtaaaaataaggattgtgttgctggaggcagcaaaacatattttccctcatctaaagaaatttcccaagagatgaaccagaatgcaaatgatctgtgctgaagtcctcgagtagactgtgagtttcctctagttcaatgtgtaatatgaactcctagcataatgcttgccacatagaaagctctaaaaatattccgtttatctttggtgaaaggctggagggaaaatggtatattcaacattaataaatatttaacatttaaaaaatttttccttttgtaatttaccccattgtctacctccagtgaagactaattgctagaatacttcagcctgccaatgagaaaacatgttcagcaagggaagtcgggatagtaatgtcctgtattacccttgctggagggttctgtaactatccattttgtcttacttctgcccggccatttcactccactgactggttctatcatatttccatttcccaataggactcttctttccattaaatccagtggctttgctagggaatgaaaagacttgggttatgacatagggttgtcatgggcttacattgcagctgcacctctctaacttaattgggtgactccaagattcctttgtgtttttaggatcttttctttaatgatatctaattccttgggttgtcctatgtaattcatgtgtaataaacatggaattgtgcaagaccccaagttgaaagcatcagttaggagttagaccatgtaaaacctatggaaataatgaagtgtttcctccattagctagaaattgaaggagtatatcttgaagatgtgttgcagggctaacattctaggatgctaacattctatatcagaaaatccagtacctacgcccaacttcttcactcatatgctgcagaaatacagaagaaatgtacctccatacctgggacttattagcattcgggtacttggtttcaatcctaatctgagacatactaccagatccccacaccctcccctcccccaaaaattaaagcttgcatttccaaactattgacaataccaaagtctgttctcattaacgattcattaaatatccaatgacataatatttgccttagacaacacaaagtagagtataccattatgggttgcttaaatcacaaattgagctgacttcaagcaatgactcccatgagattaaaatacagtatttgaggaagtagcatgcagagataaatggaatgcttactaaagagagagagaaagagtttacaataccacttttggtatagaaacaagaatctaagggaataaatctgctttttcaagtactatttttaacatttgttacatacactttgtatttaaaaaaaatctcctgacatttatggttaagaagtagcttgcaaaatctttctccagttctctcatagaggaggaaaaaagtctgtaaatattttcagaagacaagtatgcctgtaatactatgaaatgagattaagttaccctactagtaatatgatctttgcattggaagcaaattcctttttgtgatttttttcctgagttggttatacagcagactagatgacgatgataaaggtatcaaggtctaagtttttatttttattttaaaatactgtttttttttttaaatcagatacatgaggccacacaaaacaactacctagcttaatgaactgtttcaagtcaaatagctttgcaaccaccatagcggtcaatgagtaactttgccagccagcccagaatccctgtcccaagtgcttcgtctcaaacccacctacctctctgccctacaacctagcctgacttttatagtacttgctgccttaatacttttatatttttataattcaaatatgcatccatagacactagagtttatccaactattttttttctatttggttatgtcttttgtgtcttttttagtctacatgttcatccaccattctcttcttttttttaatttaaaaacacaattcattgttgagggactgggcccattcgaactgtagtttcccacagcctggaattcgagattgcagtctctctgaatccagccaggccttcatgactttagcaggactgtaggtggagttgcttttcttcaacaggtgcaaaatgcataaatccactaaataattgagggttgaaaatggtgatattcaaaatccatatttttttttacatattagttgaaataattctgtaggaatcacttgctctcatctcctatttagttacccaatgatattgttcatataggaaaggcaggataaaagccagatatttaccagttttcaagataatgatttttttcctatcatctttgaaaggtgatcattttttttaacatggcagtatgaacacatggatttaaacttacttatttgatgcattttaatacattgcaattgttaaccttgtggaagctaaaattgtctcttatttgaagatgatattttctatttaaaaaatgctgactaatgtgtattgactgataacttttttgagtactttatatgtattattcagcgtaatgctcccagaagtcctcaaagtatcctttcacaaattagaaagctgaaacacaaaacatttcagtaattctccaaagttctcttagctagatgagataaaactgcaatagaagtcagggctaccttcttgatcctgctgcatttattatggtacaagcttactaatcaaattttttaattttcagatttagtttttgtctcctatagcaaaaagatgtatgtgagttatcaaatctacatttatgcccattttaccaaggaaatggagacttagagaagttaagtgatgggttcaaaaacatatagtatatgtgcctcataagagacaaagaccaaactctagccttgggcctcctgtcctttgaagcagtattgtccttcccatggagtgatcactgaagtgattggagatagttgacaatgtacctccacatgatgtcacaggcccagtcccggtggcaaatctgcttatctgtttccaagtagagaaaagtgatcacacacaaacacacacacacacacacacacacacccctttatgggaagagaagaatgcacagttttacaacaaatagcagtgcttcatgaatgttgcaattctaaagatcaagtcaggaacctttctaaaatgaaggcaaatggaattgtatgcaggttattgtccacagcggtcataatatctcaatgtctgatattctcttgaagtttatatttttaattattgtactttctacacagcttcagcattttttttttctaaagacaaacgaataggtaggaggataactagtgagaaccgcaccccccacacaatcaccacttcatgttttctaagatgggtatatttgcaaaaacatgtatggatctaaattctcttttatatcatatccatctttctttggagtctacagtgcatccatgatcattgtgtacccctgagttactaatttcttttataaatagaagggtttgctgaagagaatttttcagtgctgatttctgaagttgcttgttatttaggtatttttgattaggtctcaagaaaaatatatggagtctttaagatgtttggaatagaagtgccttcatagctgaatgcgaaagaatccatggacacttatttgttatatatgctgggagctggtgctcggaatacctcagagaataactcacggaagtctgaatgagtagggtgggggaatactgaaaataaagtttcttgttagatacttgaactaataaaagtttctcccacaattactcagttctaacactggattaaggcacatccccctcacctcatgatatttaagtacatgtatacttgccataaatactctgtttatctgcaagatgtaattagatctctaaaaaagtgacagttcacaagacagttatgatatttcaatttagtgcaaacctgtagatttaattgcctcaaataacaacacagattgtatttcaaactcttcaggattcaggatcatctgttatatgttagtacattattacacggcatactgtaagactgggtttacaacaaacagatgcaccaaaatgctatgcttcccaaaatgtggactttagtttttacaggaaggtgaattaaaattaagatgcagatgagcttcttgatttcacagtatgttttaagtggaattgccttgggaatgaaaactagccccagcacagtagggtgactatcacggacagtattgtattttatatttcaaaatacgtaggaaagatgattttgactgttctcaaagaaattatcaacgtttgaggtaatggataagctaattaatgtgatatgatcattacacagcatatacctgtatcaaaacatcacactgtaccccgtgaatacatccaacgattatgtgtcaattaaaaataaagtaaaactttacaaaatcaaatgagctactctgaagcatttgcaatgacttcatagtttaaactgggatagaatctcaaactagaaaagggcaaggagcctgttctcactaaccatgtcactcttggagcagatggcctttcctgaaggctgcgacattttttgcatatccctttatttcaaaggctgttatggtcatgaaatggaataatgtgaggacccctaagggagctcaggcatgttcagaaatacttgatgagattatcttccaatatgaatgtgcaaggaagtgttttaattctagtcataatttaacaagatgaaatcaagctaaagatgtaatatattaattggatcttgtgtaaccactaaaagcagtgctagagacctctacatattgatgttaagacatgaacgacatgtgaatttctatgtgaaaagagcagttatgaggacggtttgtatgatagttgggttcttcctttacacacaccgtcctcatgctgtctgctgttatactttgtgtttgcctccctgcagtggcccagcctctgaaatgttttgccttcctccactccctcactgtgttctagtcccctaaaaactcaaatgactttactctgaatatctgggatctgacaaaccaattgccatatggccagtccatatttagaggagatattgtgagatctctaatctgttgctaccactattactcatgagaacaaagatccctcctactatttcttagttttttctatagattaaccttattctctggtctacaattataatcatagttttgcaaatacagattactcattctattttagttccagggtggcaaattctcaatgctatttaaacccattgtccagtttctctatatccacatccaaaagagcagaacattgctggagaaaacctcttaaacagaagatgggctttactttgtattaaaaaatgagtcaactctgtctaataatcttaccacaattgtgtaaaaaactcatttttatactgtaaagaaaaatgaattcatagagcttctttttttcctaaaagctactgaccatcctaagtacttcttgagacaagggaagactttgtatttcatgaggtaatggaagatctaaatggaaacttcctcatcctcccaacaactaacctcaaaatccatttcctcaatgtctgtcttctcattttgcccttctgttaaaattaactcagtgatctgccttctaccaatggccagtgcgttcatagtttgattcctttcatgcatacttgctcaatgatttggccatttatcccttctttctgttgaaacatacatatccctttcttaaatggtcattgataacattttataaacgtagtttagaatttctcatttttgaaaaagaaagaaaaatcttatttccttctcatttatttcctgctaccaccctatttcttctacctgttgtttttcctataccaatatttctctaagaagtcatttatatattctgtcactaacctcctctcttcattcttcaaccattgcaacttggatttctctcagaccactgtatgaagctgctcttgtcaaggtcaccaaattcagttgccccgtatttgtcttcatcttctcacctcacagcttcatttgacacatttgatgatgttctcctatttaaaacactttctggtttttggttacatctcacttttcaggattcttcctgtctctcaggctgtatttcacaatctaacttgaagcctatttttttttctattctcaatcttaaaattttcaaattccacagggctccttcactttcctttctactgccctctcctatgttatctcattccttcccagggagttaagttacaatcttagacatggtgaagatgtttctggcagtgtgctctagagctagttaaattctgggtaagcctggtgaatctaacagtaaagttgaggcatgaatctagttgctactggtaaggacttcatctctctcagagactgctgtaagcatgggtatagtgtgagaagtgggcatgtgagctgcattggctggcggcagccctcttggtaaatgccgaccaatggcatctgcccttcttctctctgtggcctgctttgccctttctgtgttgtctggtttgtctggtgagaatgtacctttgctgctataattttcattaggcaaatatttctctttatttaaacttttaggttcaggggtacatgtgatggtgtgttacataggtaatctcctgtcatagggttctgttgtagagattattccatcacccaggtattaagaccagtaccccatagctgacttttctgctcctctccctcctccaagcctccaccctgaagtagatcccagtgtctgttttttccttgcctgtgttcctaagttctcatcatctagctcctacttttaagtgagaacatgcagtatttggtttctgttcctgcattagtttactaaggataatggcctccaactccatccatgttcccacaaaacacatgatctctttctttttatggctgcatagtattccatgttgtacatgtaccacattttctttatccagtctgtcattgatgggcgttgaggttgattccatgtctttgctattgtgagtaatgctgcaatgaacttacacatgcatgtgactttatggtagaataatttctattcctctgggtatatacccataatgggattactagttcgaatggtagttctgcttttagctctttgaggaattgccatactgctttccacaatggttgaactaatttacactagcatcaacagtgtataagtgttcccttttcttcacaacctcgtaagcatttattttttgactttttaataatagccattctgactggtgtgagatggtatctcactgtgattttgatttgcatatctgtaatgatcagtgatattgagcttttttttcatatgcttattggctgcatgtatgtctttttttgagaagtgtcttttcatatcctctgctcactttttaatgtttttttcttgcaaatttgttgaagttccttataaatgctggatattagacttttgtcagatacataattttcacatgttttctcccattctctaggttgtctgtttacactgttgatagtttcttttgctgtgcagaagctcttaagttagttcccatttgttgatttagcattttttttcttgatcatgagcctgacactggtatgggtgctgggactgagacaataataacagttaaccctgacatagaatttactttgtgccagacatgtttctaagtcctgtaatacgtgaatttatttaatcctcacaaataccacattttacagatgaggacacgtagactcagtgaggtgaagtaagtttcccaaggtcaaaaggctgggaagtggcagagctggctttgcacccagaaggtttggctccaaatccttgaagtcaccagctggtgagaagagacacaacactcgctacattacaaggtggtaaaagatgaaagagaggtttggaacacgtggagctctagggaggaaggtcctttctccacctgggaatgatttccagaggcaatagccatttgggctaggatttgacatttctaacaaaggagtagaaacaatctcacaagagagaaatgcattgcaaattgcagaaacaaggaagggtgtggccatcttgaggcacttcgagactttcatggtggctagaggataagcttgtgttgcttttgctgtgaggaaggagatggctcagaatgatgcaaagtcaccagcttggccattagcaggctcagctcaagtgcctattgcctgaattaccattcttccttatctctacaaggcagttacacaagaaaaaccccttgggtgtctctcagctaagatttttttgtagttatagaaaacctcctaaaccctaagccatgactcagctttcctgcagattaatctagatgatctaagcctagttctgtcactgcacataactcaggccccacctcctattgcataccatttaaaagcagggtgagcagcaatcaagacctgctggaactgagggggttcctcgattgcattacattaagtactgaaatatggtaattgcagacaaatcaggaagaatgggataaactatctgaagtctacctgatgtgccagaaataagatgcatgacaactcataatgcaaagacgtcaaattcgcatttctctaaagtatagaataactgttaaataaatatagagatgctcattttagttttacattcttttaacctctactattctagttattttctcttatcaggtttgtgttgtctaacaggtctgcttccgagcttaacctcatattcttgggcatttctctccctatcggatatatagtcttccatgtttttgttattttctacaaaggaaagtgctctattttttgattatttaaatattacatgttccttctaaaaatattaaatatataaaaaacataacaaaaaattcaaaatcacatgaaattatattactctgagataaccaccattaataatttgttgaacatacttgcatttgtttgtgcatatgcatatttttgtatgcatgcataaaatttcataaaatcgtattattactccttcctaacttattttcccctctcatctatgtatttttttttctctttcttcctaataccatccagctgatcatggtaaccactgttgatttcttggagcatagacttcagttgagttcaggtcctcaagatgcagattccaagacaggattatatgtgaataaagatgtatttagggaattacctacacaagataaagggaaggaaggagaagttgagaggagcctttaaacaggcctgacttccatgaaggaaaagagaaagtctgagactaccgtctagttctgaaaaagtttggctaagccgagggggattcattgaaccaaactcacccagttgagtacttacaacttgaaggaatgggcctctattatgagccatgctgtgtccagtcatcaggtgctagtagcctgtatgaagagtggtcttagtatgaacaagggttggacccagaaggacagcagctggtacgtttcctgcaacccagaaggacagcttgtatgtttcctacagcagatctgagcagcatgtagcttccttcatatttgtatggcaaagtgcaaatgcacatgcatgcataatggtccttagtcattgtttttacaaatataaaatcattttatgtacactaaatattgctcttgtcactaaacagtatcaatggaaagtcatccaagtgcagcaaatataggactcattcttttcaagggacaccatactttccaatacttatatatccaaatttactcaagccatttgttattaatgagaattctcttgaggcctaaatataaagtattaaaacacttgtaaataaaaaatttacaagttttgttttgcttaaaattaggaatttaatatatatatatagtaagtcagttgtaacacttccattttccttgagcttccaaaattttgttgacatcaatttttttcattgtcatcatctttcctattaagtttatcttcaagtattcatgtttttaaagatatatatacttaatctttttaattctcatttttgctttgaggaataattaaaaataaaaatgtgttaatatatcatatttcatgatttattgttacatattaacttttaacttattttttccagtttttaaaaagttggtattttatttgcaattttatattaagaactgatttgattttcaggtgactgacatttttattattttttattgtatccaagaataagatatgtcattacttaagttcaggctatgttttatttctttcaataagatttaataattatttcctcatatgttttataactttcttattaaattaattcttatgtatatgatagtattatcacttctgagaacagaatgttttccatttttacttatattttggataagtatcatatatccaactaccttaagtgttcctttattaatttgattgcttctttaattggccatcttgttttatctagatttattatgatattttcagtaaaattatagttttatttttctttcaatctttatctgaatttattaaaaatgttaatcatattttatgtaactatagtattaatagacacttccatcttatccatatcataatagaaatggctttagtattttggtttttaaaagttgtaagtttttgtgaaatgtctcatattaaagagtatttcctctttttctattttaatttcattttaaataagaaacgactggtttatttaattaagtaatgttttatgtattgaaataattatatgactctttttctgttagtttttcaatgatgcatgagtcttataggtccctaatatattaactaaatcattattgtgttctacctggtagtatttattgaagattactgtatctttgcagacatagatctatttctaatataccaatattcctgttctataattttctttcttttactctctttactgggattgatttttcatttcatgcctgcattaaaaatgaattgataaagtgtccatctcttcctatagtctgtaaaattttaattatctttgtaattgtctgctatttaaaaagaaagctagacttaggaaaaggaagtatgttgttttaatgcctcttgggggaggaagggataaaatctttaatcatttacttgcaccttccaccgtaaatggcctatttaaatttgctgctttttgttgttgttgttgttaactttgctgctttaaaatttacagtatgccatcatttttacctggcctttaaaatgtattgaaatatttggccaggcaccatggctcacgcctgtaatcccagctctctgggaggctgaggtggacggatcccctgagctcaagaatttgagatcagcctgagtaacatggcgaaacctcgcctctaccaaaaatacaacaaattagccgggcattgtggtagacacctgtggtcccagctacttgggaggctgaagtgggagaatcgcttgagcctgtgaggcagaggttgcagtgggccaagatggcaccactgtgctccatcctgggttttgtatttcttcccaacactcccatccttaaaatggatcctaacccttgaatttcaagaaatatgctagatcccaatcacatttctcagttttgcttaaaccagatttgtctattccaattctccaccatattctctgtctcatgcagacttgcatgtgtaaaataaccttaactgtaatatctagagaaattgagaggaaaagacatagaggtgaggagatgtcagctcctgaaagatttttaaccatcataagccatttgaacttcaatatgagggcaataggggtagggcatagaactatattaagcaccaaagttacttaatgagactggtttattttaaattctctacttcttttctcttaaagtggtcgttaataacatgcatcttggaattagacaaaccttcctacatttatttgatttatgactttaagcctgaggttccatatcaataaaaattgagacactaattttgttttcacaagggacatctgaaatattacggtgctaaattatgtgcacagtgcttattacatagtaaacaatcaataaatgatattcaatcaacaatcaccatcatcttcgtcttcatcatagtttctatctctattatgttacagatataggtaaatgtggtctttttagtgaagcatatagatttttcccacagtcttgattggaaaagtgagagtatagctgattgagagaactcactgtcagctgccaaccaatacagactgttcaacttttgtttttattttgttgaaaggtctttctcttgctttcatagcttgctgtaaatactgcattctaatcactatgatataaatatttttgataaaagaattaatggaaaagtaattgtagagacaaaaaactgagaaagtttggcattaattatcttgaaacacagtcagtccctctgtcatttgcagatagtcactacttttaaaagcaaatagttctattggtcatggcaactctcagtagcagctatgagaaataaccaactcatggctgaatatagtaaaagttttttctcaatcacatcacagtttaatgtttgttgggtggctctcctgagcagcaccattcctctggagtgacgtggggacctactgcttctatctagtggtcggccttgttggaattttctatttctagctgtaagggcaagggacacagagtgggtggggaggggacacagagtgggtggggagggcaccctggctctttactccctgaatcctaacatggcacactgcacttccagtcacgttttagtggccagatattagtcacaaggtcaagtataaatgtatatttcagccttctgatatttgcacacagacttcctgagtgtgcagaaagagaaaaatgggcagtttaggaaacccagggatgtggggaggtgagtgtatacccacgtatataataagccagcaacagctaaagatttagaacatggcatccagatccatagtcattttttaaatggacaaataccatagtcattttttaaaactttgatgagattatgaatgagaaacaattgaacattattttttgaagccattatttatttatgacatttcctattcattttacatttttttcacatacgtaaaagagaaaaattggatgtacatatgcgtgcttaacagtggaatagtgttgacatattttcccctcagggtttcaccgggagttcttaactaaaaaatatgtatcctcataattaattaagaatgttattaattttgcatcaataatcattatctaggtgattttatttcatttaatcatgcaatatggctatttctacctctgagagtcagcctgttccctgagattttttctaattttttatacccagaaaacttagtatttatgtatattttcagaaaaagtattaggtgaatatttatatttttattattttattttctttaaatacaatatgtcacatacttatatatgtgatatgtttcacatatatcaaaacatcacatatttatggtgaacaatatgatgttttgatttgtgtgctataaacaaatccagctaattaatatatccatcatctcacctacttatcattttttgtgatgagaacatttaaaatctactcttttagcaattttgaaatatacagtacatcattattaactatagataccaagctaattatgaaactaaaattttctatctttttgatgtttcaacaatttcaatattttgaaaatatttaataactgaagtgttattcatttgagtatcttaagatgatatattcaaagagagatcatacaatatgataatgctattaagcatttttacaaatgttcaatgatattaaacaaattaaaattaaaagtacttctatttgtgatgagctcttaatacataaggggtcattttttgagaaacagctgttatattactttcttttctcaggtatgtagttaacagataaaagtttagataatgaataaaatctcacagatcacttttccatgtgcatacattgtttggataaacaactgattaatgatgtctcatcctttcaatcagaaatgtatttgtaggaaataaaaagtgtgaatgcttgagctgaggctgtcagtgatattattttgcataattatattttctgttgattcattttgcatatttctttggatggagcttctctgaattgattaaaacttccattttatcacctatttgaatttaatttttgctcaggaaattctgcttcgaatggacattttgatgcatcatattcataagaaaaggaaaagaaagcatagaaggtgaggggcctgggagtttccacttaccttgatccctgtaccatttatttgctggttaccagttcctcctctctgatatgtggttgggataaagttaatgggtaacctttcaggctcaacatttctcagcgtaacacttctctttgaaccatagagaaagagaaattcttagactctaacactctatcttgttgctcttaagattccaggtgaatccggacacaaagtgcctattttacacaataggatcctgttgtgctgagtgtgtcagagcataggctggcatctcatagctcttactgttaaaagaaaaaaaaatatggcaattatttctttgtcgtgagatgacattctctgagtgctcagtatcttcttaactcagcaggaatactctttgtaatatagaaagcatacaagacaaaaggcaccttcccaatttgtgtgttctttcttttaatcttgacaaaagtattgcaggcctctttggtgccagattctgtataataccctgaaatgcagagaccttgtgtgcttagatgactaatacaattagatgacagggcaaaaagaacactgttgggaacgaggttcaggaagagtttgtcataaggatacgaagtggaagggcattccccgccagagaaagcagcagcaggaggagcagacctaagatggaataatatgaacatatggcaaactataaatttcatggaagacttgaatgtgaagtgttggggaaaatgccaggtaggcaggacatatagccacaccctactacagagaatcattgtttctccttccttacacatttggtcttctaggcagtttatctcatgtacatggagagtgaatatgggttctgacttggccttgtacagccagttaatgacttccctggattccaacaccaaaagattcagtctctgaaactagttaatagataattggaaaaatgctgcaagcagttttctcaggatattcatactcaggatccaggttgtagctcctgttttgtgggtaacagccttgactttcatccttcaatccccaccaaacacacacagacagattttgatagataagccagtctccagtggcccactttatgcaatctagacacctaacagtctccttgtttccatctgaagctgatttttgttttttgatcggcactaccactctcaggcttggttgattggagaatttgtgatgcacacctgtcctcaattccagaatgctgggaaagtcattgacatgactttcttcagatgatttggtttgggccgtattaaattttgactatttcaccaccttctaatctagtacttagattcattccagcgttggaaggtatgtaattctgttgtgatattaaggtcactacagaatcagggcaaagaggagaaacacagaaaaatgaaaacaaaacacgcaggcttctaatgagaagtcgcatgatacagactttaaaagcatgggtttgtgagcaagacctggcttgaaattcctcttgttctacctcttattcgccatagagatgattgagcagttgacataactagtgacttagtttcgtcttccataaaatgtttttctacattattagcttactgtgatgaaaaaataggataatgcatgcaaagctccttttcccagtacgtggcacttaataagccctccgtgaatgttaactattattcttactttcatgatggtttgtaatcccaagaaaagataacaaccgtttttccttttggcttctttctttggttgttttattttgtttgtttgcttgttaagtgttcaatagatatttgctattttttaatataacagttgactgttcttacttttttgggaggtggatgtatgcaatgtattaaatatggtaaattttcagaatcgaagaaaaatgcttcgttataatacatcatggaatagcacacgtgtgatatcttaggtgttggaccacctgagaagtaaaggattatcctctacattttgaaaagttctgtgggtgaaaagaagaaggcatggccaaagaatccgaaattaatggattagttatctctcaaaaatggaatttagtttataaagttataattaataaaataattaataaattacccattgggacagaaagggaaaacatatgaaagacatatgtttatatcccaaaatgctctgacgaacttagatttgaaaagaaaagaccatgtcaggaatagtcacatgagggttacagatttttgtctttattatgatgtggtattttgtttggacctgagaattggtagtgatagattaacttaccaagtagtagatatttaatcaataaaaaatttttctaaataaaaaaatagtcgtctgaaacataatgggctttgttagtgggaggttgtttaggtcaatacaagataatcactggtgatgttgttttgctctgctgtgggaacaaataaattccaaagttgtagtgtcctcacagtaaaggagtttatttcttattcatgtagagttgctgtaggtctggtgactcttcacagcaatactcttccaagcgatacctgaaggatccacgctgttttcacctctgtctccaccatctaaacccacaggttccatggtcatctttgaagggcagagagagacaaaggagccccatcagttcttaattcttcatattggaaatgaagatttttatggtcatatttctgtttcctaataatatttatacttagctcccattctgtctatgaggaagtcttggaagtactattttcctgtgatataggaaacacctaacactctcggccactaaggatatttctcatgactggactataggacaatcctaaatctactgtcagaaattccgatgattaataatcagggtttgcaaaatttatcaaatgaatctttaactaaacaatgcctggaaaagagtgtttaaactggagaaatacacactacccacagttaaaatttagtgtctgcctgggtataaagaatgtattatatctggtaaacatccatccctagatacataagagcactaagaggcttctcttgtaaatctcctctgtgtgtataggtagttacacttgacatttgctttgcttgttcaaagctgtctctaatagctcagctaaggagataatatgtgagacaaatacatataaatcaatctcatatgcaagatatttctgtctctataaatgatcctgtactccttcttgccatctctaggagcttaattccttactccttcattgaattgtcctaaatcctgctggtactgcttccaaatgtctcttcagaggtagtttctttacaccattacaaatgatttttttctttaatgaaggccctcatatttcatcttcaaactaattaatgaactcatatatattccacttttttgtagcacctcttcttttgcagctgcagctgccaaaatcatacacctaaagctgaagacagtaaggaccattgtagttaagcctggacatcctggagtgagacaccctgtaaccttggacttttcttagcctttctccttagttttgtcatttcttaaatgagagataagagtatcttatgggcctaaaagaggaagataatgaaaatattatacattaaaacatcatggcacaaatgaactagaacggatgcaggccatagttggacaaatgccatacccttcattgctggatcatggaagcttctaggagtattcttgataaggaataaagaggcaaagtcatgaaggaggacacacttgcctaggttttggcagtggtcatttatcagcattacaggagcagtttagtaatttaatattagtgtgagctacctatcagctgaacatcagctttagtttagttaactctgtgaaaacactgaacacagtgtacagtcaaggctaggttaggaaatgctgaagtaacaaataaatccagatcttcaggtattaacaaaaattagtttattctagaatgatggatttagcttgggaacagagcctggagatttgtccatagctctaaagcacttctccctgaaggtggccccctttacttctgcacatattccattgaccaaagcaagtttcatggtcatcccatcattaaaagagtagagaagtactcagaagaggtgagttaggcatatcgaagagccagggtaatgtctaaatatatgatgtctagctcattgttaagtgctccagttattattaaagtgtattctgattttttcatttctcagttcaaattacgtttattggatctgctttacctccttataacacggaaactccttgttgtcgttgacactcattgtgatgtaaatcctaactacattcctgtttatatgttatactgcttcacttcattttacctttggtctgtccaagcagaattatttggttttctcatcaatgcattgtttttctctacatcactgcctctgatgtccctttaccattagtgctttaactgaatctctccatgccagtaagccttctaacatgtcaggttctcaagttcaaatgccctaaatttccattcctgatatcaacttctgtagtaatatattccgttaactcttattttgctgttagacccaacattatattatagtcatttttatatatgatgatgtagcattatagcctgaaaacttatgaagagtccatgcctgattcatcatgtagccccacttgtgagtaccttactcatagcagttcaataataatactaataataaaattcatcataatgttacatttagtggtggcatcagcctaatgtaaaatgagcattggattagatattttaaaacttctggattttatttgcaccccagttactaactagcagtattacctagaacaagctgcttaacctattggaatttcagttttctcaactctgaaatggatgagaaggaactttaactgattttccccttctgtcttacaatattgttgggagaaccaggtcagatatgagatcatagtatgtgaaagtattttacataaattgtcctcattctgatgtaccaaagctaaactctggttttaagtctacagtggattgattcttcagtagcatttaattctgtttcccattctgttttctccacggaatgcttcttagaaaacgttttgggtttcataacattttatctttctggttttctgcctatgtctcctttagctgaccagtacagctaacctttctctttatcccttctactctacactctttgctagataagttcattcataccataacataaattcccatctatgtacaaataactcacaaatatttatatcctgtcaaagatctctcatatgagtgataaatccaggttcttggttggtttctctacttggatatactaacatgtctcaagcatatcattgccaaaaccacactcttgattcacacttgccttcataagtcttgcaattttccagtgtttatttttttctgcaaatggcacaaccactttcttagttttaagtgttaaaatctaggttttctctttcttcatccacaatgccaaaagtactgacatgctgcaaaccttaccatgtgttcttattccattaatgagaatctaagccaaatccccaccctttcttataccttccaaggaaatactttcttaactggtatttctttccttcatcaatctattccctatactgaatcttttcaaaatgtaaatcctatgctattacttaaaatagttaccactgtttgggaataaaggttaaattccttaacctggccttaaagaccacatgcaatgtgttggcatctacttctgtagcctcatctcctgtcaaacataatgttctctctacaattttgtcttgcgaatactttccatagttgttatttttactatttgattgattagtcaattaaatatatatttttctcattggagactttgagtttcctgatggtagggagaggtgatcttttttatatctcacataacaagcactgtgctttgcagacctcaagtacttaataaatatttgttaaatgaataaagagtttagtaggtagacctgttttttaactgtgtattgagattgactttttaagaggtgcaataaaggcacaaaaaccataaatattaatgggcatgatttgaccttcaaggaaatcaagatctattggtaaatatgcttaaaaacagttaagattgaggggaaattttgcactaaggaagcagcaaatcttctcccggaacgtggtttgatatatagggcttgacagaagaagcttccgcttctgatctctgattttctggaggactcatatgtaaaatttctcaaacctttcagtattttctgttcaaagattataactgtctttcattgttatgtttccttcaatgtgacaggtctcagtgaccacacattcctcatatatatctcaaacctggaaaatttcagagtactcaacacattttcaactataaattccccttttctgtgcttttagatatctatttatctctagtttatgtgttgtatttttgttgtagcttgattatttctcctcgactcaatttattataaatgtttccatacataggtatatatattttagaaaatctattaatattttctctatgtcttctaggttttgtatcctgttaatgaaagcctgctctaaactcccttatttaattgttaaacatttgacatgaaaaaatcatccccttaacttataaataacttatattaatcaataagaaatatacaaataggccaatagaaactagacaagggattgaacaaaaaaggcagtagaaataataaataattttagagaaaaaatgttttccctcgcatttaaagacatacaaaacaaagcgatatgagttttgtaatctgttcaagttgataacaaatgtttcatctaggttatggagcagtatttattattatacatcactatttggagtgaaaagtagtacaaaaatttggtgaatacatcaacaatgtctgtcaaaatataaaagtacatatctttccttatcagccatactactgttgtgaatttactcaacagattattttcaaaagaatagcgagatacttctgcaggaatttctgttgtacaaccctttgaactatcaaacaaaaaatgttggaaacaagctacctatgcattaataggaatgtgattagataagtcatattgattcatccaaagaaaagtatgaagcagatcaaacagtttaaacaattgaagtggcatctgtgtgttcaagtggtaaccattaagaaacaaatatacaaaaagcccatggtgaataactagtgattactttgtataaataaaaatgtatatacaaatgtatgcaaaaatatacatgaaacaatttttcttgaaagatacattaaaaaaatgtatagacaatgaatacctttggggaggagtgcagttaggaagtaagggaggtaataactcttacttctcatttttttcatttcataactatccttgtactgttttaagtatttattacacagtatgtgtattactgtcatgttttttacaaaaataactgacattaaaccattttaatttctatgcttcacaaaaaatttctaaagctaaggattttaaaaattcttcctccttttgtggaagtgaattctatacttgaacatatttaatattgtataatgtatcctcttttctttgaactgtagccctcagcatttttttcagctcctcgtgtgttcttacttactgaatctatccttattaagctgctaattctgctatcaggaagttcttggtaagttcttggtatttaggattgtgcaacaaaaattgaagtcaactattttgtacaaaaaaaaaatcattattctacattaacagttgattttggaggtacttagtaaagtcgactcaatcatagacctccaaatggaacaaacacccttacttgcatttcattgtgatttttgcaggccctttgcagtaatagttctgaaaaacagtcagaaataaacaacttaaaccctcaaacatattttatatgctttgaatttaaagcactcatttaaaagaaaaattcaatcaggtggttttttttgtgtgtgtgtgtgcctacatttgtttaggtttcttcttttattttttatttttggcccttattcctctttcttttctactttcccagaaattctggtaaaagtaatgtaaaaaatgtgaatacctgatcagaggagttgcttaagaaatgtctcagctgaaaccagtactttagtaagagtgctagctgcttaacaagtcaagggtgtgaggagctatgaataaagagagaacattttgccatgaattattcagttaaccatgggatgctgttatctccacttcagtggcttttaattgcacatgtaagaattctgcttatctggcattcaatttgatgccaaggtgcagcttgctcaagcagggctggaggcaggaaatgaggatctcatcagacaagcagctgccattcacgaatgcattaaagaatatggcatagactagcagggaaggcagaagacagacacagataatggcaatggaaggatatgtgagaatatgtgacaagagattgtcttttccttttgatcttattgcacattgctgagtcttgagtgaaaagtcaaattgtgtgtgctacctaaatgtactgcattgcctttgttagagacccaaggttgacctctggagcaaagatgacaagttgctctttaaaccattctcttggaaaatctggtattctttcagtctaaatggagtcctgactcaattttgagattctgttggttttaatttttcaaagtttacttcagataagtttgtttatcaagataaataactttctcaaagcctttttcttatatcaaatttgcagaagagatatcttttggcacctgtgctgtaaatgtttcaaaacaatttacttataaaataccattttaaatattttcagaagatttcatttggaaccccttctccatttaaacctctccgcatagtatgtgattcctttatattattgcatacatccatttccaaattgaagtgcttatgcaacacatgagtttcatcagttaccatttgctgtgtgctgtgtagtgcataggagatgtagagattagaagtatccacagataaagcacccttaccttatggagttcaaaggctaaaatgaagatgtgcaacacaaatctgctggtctgcatggctgttgctgcatgggaagtttatgccagacaaaatggaagcacttttgagggtttgattacccaaggcttcctgggagaagggactggagaaactggaagagacctcaaaaaaggcttccttcagaagacaacatttatgaaatatgataggtttgtagacatttctaaatttggcgaaagaagaagtgcaggaatttcaattagtatagccattatggaaaacactatggaggttcctcaaatgttaaaaaatggaactacaatatgatccaaccaatccactgctaagcatatatccaaatgaaatgaaatcaaaataccaaaaagatacctgcactcccatgtttatggcagcactattcacaacagccaagatatgaactcaacctaagtgtccatcaatggatgaatggataaggaaaatgtggtcttattacacaataaaatactattcagccgtttaaaaaaaatgaaccatatcatttgcagcaacgtgggtgaaactggaggtcatataatgtcaagtgaaataagccaggcatacaaagacaaataccacatgctctctcttatatgtgggagctaaacaagtgaatctcatggaggtagagtagaatgatggttaccaaaggctgggaagcatagggcagaaggaataaagagacttgtttaatgggtacaaacatacagttagatggaaagaataagttctagtgtttggtagcacagtaaagtgactgcagttaacaatatagtgtatttttcaaaatagctagaagaaaagatttgaaatttgttcccaacacaaagaaattataaatgtttgaggtgacggatatcccaaatacacagattggatcataatgcattgtatacatgtatcaaaatatcacaagtacctcataaatgtttataattatgtatcaattaaaaaagaaaatgtggtatacatacataatgcaatactattcagccttacaaaagaagggatttgtgtcattttgataccatagataaacctaaagtttatgttaattgaagcatgttttacttaaacattatgtaaatgaaataagccaggcacagaaggatgaatatcgcacaatgtcatttacatgtgaaatttaaaaagtcaaattcttagaagcaaagagtagaatggtggttaccaggggctgagaggtgaggggattgtggagatgttggtcaatggacacaaaatttcagttagagagaaagaatgagttcaaaagatctattgtgcaacagggtgcctatagctaataattatgtattgtattctcaaaaattgcagagtggatagtgttatcaaaagaaataaaagctaagtatgagaggtaatacatatgttaattagctccacttagcattccacaatgcatacgtattttacaatatgttgtacacaagaaatatatacatttttcatctgttaaaaatagaaaacaaaaacaaatctgtaaggagaaaaagtttagtatcagaaattaaagaatactgaatttaatcataaaaatggcctctgaaagaaagttgataatcctgggggacagcataagaaaaaaagaagaaaaaaagaaagaataaaagatttagagctgtggtgacaagcttggagggttggaagaatagcaggttattaaattactttttgggacaatagggtgcacaaggcagaatggcaaacaatgtgtgaagagtgcacatggtgaggtgccaatttgtgaaatgaagtccatgtggatgttattctgaaggcagtgaagaaccagtgaataattttaagcaggagtgacgtgatcagatttgtgatgcagaacaattgttctgatgacatcgttcctttggcacagttgttgatggggctccactataaaaacgaacacaaaacaaacaaacaaacaaagaccacttcatattagcatttcctatggggccaaaaatcaaagggacaatatagattaattgaaacagcagatcatttgatatcagaagaattgggtcttgttttatgttcttccattttttagcaacataatttcggacaaagtatttctcctttcccattaggtttaagttcaacgtatgtcaagagcttaaaacaatttctcatgcatgagtgaagcttcataagtgtttggggaataaatgaatggatttctgggtctccgtattcttctactaagtaaggaggatcaaaaaaatgttctgagagtcatcttccactactttggaagtgactacaaagtgacacatgagattagaagttaagtgaacaacctatattgtatcccttcagggaaattatttttgtattaatattgttagtctggggaaagtatagtgggagaggagaaactatgaatcaattttcagacatctttttctcctctgttttgttttgtttttttaattttggcagtctcttctttcctgccttctcttttgctggatgtttttatattcctacattttaaatatcttacttccaaggatgcaatcctgggacaccttatctttttgcttactgggcatttctgtacatacttttcccccatgtacttcttttcccttatattccactgtgctttccttccttaaggtctcaaaaaaaaataattcctgctcccctcccctcctagacatctaatataatctttccaatgggcctgagcttttccaaaaggcaagcagaaccatttaattaggttgtgtttagtttctgcccagtgaaagtccctgaggaaaggaacacaaaagcaggctgtcacattgaaatatgtgagggttcatagttggggaaatatagaaaaaggaaatgcttataacttaatttattggattcagcatagttacttctttgatattgttttgaagaacttgatgtgctagacaactgccttttgtgttcaatctaccatctgaagtcctcacttctttactgtaattgctgaaaattctaacccccaggaaaggggacaaatttcctgaggattttatcttgtaaactcttgcagcaccagtccctagcccagtgtttgagacataataggtttgttagtaaataaacaaatgtctctaggcacatgctgatggcttatttttgcagaaggctgaagctgctgctcaggaatttgctcatcatcagcttccttctagtgacacctatatcttcaattgattctggactcttcatctcaaagcaatgagtgacttttatttgccagttctatgctttggttaatagttttccaacgttttattattttgttcctctaatttctactttttttggttgcagttattcaagagattgtgactaaatgctgcattcttagaaatttcttctctgaatcaacctctagtttgaaatgcaatatataattcccaacataccaagatcatgtgtcttattcctttagataaagtttactatcttaccttgtttcaaaattgtgagcatgacttttataataactctgcattttattacaggagggcaggtaccatgctgtgatcttcctatcctggggcctagcacagggcctaacagaagtcgtcaatatgtgtttcaattgaattaaattgaatgaagtgtaatttctactcaaaacttttatagttataggaataagaacaaattttacaaaaatcattgtaagttacaaattaacctaaaattacacagtcatatatatctagcaggagaatttagacaaattctatacaattaaaagtaaagttgaatatatcattgatatttaggtattatttttctgagaagagaagcttgatcatatcagaaggatccctacatttaagagaaaataatcccattgttttgttgcactagcttaaaaaaatctttctatgaccttgaactcggtaaacactgaaaaatgcaaagtgtttcctctcaagggcctcttttatggatgtttcatgaattttcgggatgatgctgttcatctatgttaatggattagaaggaccattgttctaaacagtgaaagataaatatacagtccctcataacagttttgacctaaacttttgtcatatttataggttttcttcctctcaacaatttattttctctcatggctttgttaaattaggtagttttattacaaaatttctttgcaagctttttaaaaagtctcaggaaactgatcacgacaaactctagtgaaagtctttatttccatggtaaccataatatgctctaagtatcttctcatgaagaggtagaaccaatgttaccagcaaaacacagacaaaggccaataaagaaggaacacacaaacacatgttcattacagcaatggtgatcagggctgcagtcaccctcctttcaatatttaattcattaacgcaagcagattttttaatagtataaaaacaaatggagaaaagtacaaaatatgcagtgacaatttttgatttagaataaaaaatgttaaatgccatttattgttaagttcttaattttgtaagaaaatattttctgacatctaggctaaaatatcaatgaaactcaagtttctctgatcattgatattttagcctagatgtcagaaaatattttctgttaaaaccccgatagtaaacaggtaagataagactctgaaagctatatggtttctgtgcggactacttggcaataagtaaacaaataagtattgctgtgttacaataaaactttattttaaaaaacaggtaatgtgccagaattgccccttgatctatagtttgccaatctcgtttattataaggtaaaggtagtattattcatattctacagatgagcaaatggaggttctgagaatttaaacagctcaaggtgaggcagaatcagaacacaaaccaagtctattgcattttaaagcctgactcctaaatagctacgcttatttaataagaatagctggcatacactggtgcctaatgggacaacagtgtgctaaattgtttatgtccattactttgcttaacttagaaaatccctgtgagataggtatgattagcattctctttttatatatgaagaacagatacttgggaaatctaagaagattttcgaaggtcaataaaatagtaactctatctttgttcaaattaacttattctacttaattcagtgactgaaataatgaaatcattttttaaatgtgacctctatgatctcaagaatataaaaaggaccatgcacatttaaagagtacctgagttctggtggatgctttgagatttgcaatgcttatttctcaatctgcagctttactttgattgtaacttggtttccattcagtctactttatgaggtgtaatttcatgaagaggcaaaaagggtaattgtagtgtgcagttaattagaatttctaattaaaatcatccttaaaaaaaacagccaatgccaatggaagaatgattactaatctgtaaattaaggaaactgtatactgcaagattttttttttctactggattgaaaaacacccagtttaagttaacatatcataaataaagataatcaccttaaataaaggtaaaatgcatagggcaataggttgatttaatttggccaaatgtaattcagttaaatactggggattctgtaactaacaactaatcttgcttcacttcccctccacagccttcaattccttctttctaatgtttgggcacagatttgattttctcaaataagggctcagtaaacctgtcaggctttcacaattccattcgtatgtctatacacaagcacacatgtgcgtttgcgtgtggttggcaagaacacatgtatgtgttaatgcatgcctgtgagtgtgtgtgtctgtgtgctctgtgacatatgggtaaaatttgtagcatcttgcttgatactcacaggttaacttcttgcttcaactccatgttgtagcaacaaacatttccccataatctcatttcaccaggtgtaggaaacttcaaactatcttaataacttaagaatctttctgaagtcatgcagaatctgttcattctgcatttgtggccatggttacataaaaaagtaatcattgggaaaaaatcttatttatctgtatagtaatagtcaaaattttgggtcaagctgtctctgaaaattatgctaagagctttgatagaatatcaatacagtcactccttggtatctgcagtatctgtgagggattggttccaagatccccaaggataccaaaatctaaggatgctcaagtcacttttataaaatggcataatatttattataacctatgcacctcatcccatttatatatctctagattacttataatacctactacaatataaatgctagctgaatagttgttatacttcattatttattggtattattattttctatgtgtgcttgtttgaatccacttatataaaatctgtagatatgaaagcctactgcatcatgtttactttttagcatgctaaatatgtaaatatctttttgaaaattaataaactgtatattttcgagcagttttagatttacagaaaagttgagcccaaatacagagttcctatataatcactccccccccacagtttccactattattaacactttttacaattgaagaacaaatatggaaatattattattaactgaagtccgtagtttccattagtgctcactctttgtgttctttgggttttgacaaacacatgatgtcatgtatccaccatcagagtataacacagaatactcacatttccttgaaaatcttctgtctttcatctattcatccctccatcctcccctggttcctggcaactactgatattttttactgtctctatagttttgccctttctaaaatgtcatatagttgggatcaaacaatacgcagtctttttgggcttatttttatcacttaatgatatgcatttaggattctctacctttttttcatggcttcataggttattcctttttagctctgagtattatccaattgtatggatgtaccatagattgtttattcttgtttatttattatttgcagttcttctattgaaggatatcttggttacttccaagtgctggcagttatgaataaagctgttagaaacatttgtatgtaagtttgtaagtttgtgtgtgtgtgtgtgtgtgtgtgtgtgtgtgtgtgtacataacttttcaactcatttgagtcagcacctaggagcttgattgctgacagtaagagtatatttagttttataagtaactcccaaactgtctctcaaagtggttgtaccatttacattcccaccacaatgaatgagagttcctgttgcactatatgcttgccagcctttgttgtctatgttttggattttgatcatctaataagtgtatagtggtatctcattttgcaattcactaatgacatgtgatgttgggtatattttcataggcttatttgccatctgtatatctcctttggagaggtatttgtttagatcatttcccactttttaattaggttgtttctttacttattgttcagtttaaaaaattccttatatatttttcatacaagttctttctcagacagatacgtgttttgcaaatattttctcccagtgtgtggtttgtcacttagttttcttaatggtattcttcacagagcagaagttttaaattttaattgatttaaacttaattgataagtcccacaccaatttttttctttcatagatggtacttcatataaaattaattgcccaaaattatagagatagaaagtagaatgatagttactagaatatgtgtggggatgaggagaatgggaaattattgttctatgggtatagagtttcagttttataaaatgaaaagaattgtggagataaatgttggtgatggttgctcaatgttattattgtatttaatgcaatagtacaacattttaaagtgtacacttaaaaatgtttaagatggcaaattttgtgttatgtgtattttaccaccaaaaaatttggaaaaaacttcttcccaaacccaaggtaacctagattttttttccttgttatcttatagaagttttatacagttttatattttacacttagatctatgatctattttgacccaatttttgtgaacaatgtaaggtccgtgtttagatacactttttttgcatagagatgttcagttgttcagacacatatattaactttttgtttgcttctttattgatatttatagtatcgaatcaatatttccaaaataagaagctcatcaaatgcctgtgttttagggttcttctttgccatttccttattgctaggaattcagcatctaggcactcatttgaatggatttgtttgaatatttatactcgtcagcaaaaaaattcccttttcagtcttagttgctttggctgctacgaacagggtggattcttttgagtatatgagagtatttgaggtcatggatagaagagcttcattattcaaattccatatcatcagaaaaatggggaaataaaatgggaggtaaggatacatatctcttattaagtagctttgggagatgtcagaatataccacatgtaaacttctgttttcacaaagggcagggggatgagtgagcacagggacctgccacagtttctcctatgtagcttctgatcatttctgttaaatggtatggctcccttcttgcactattctttaagtcttctcagttagatcattcttggacatctgttcagcttaaaaatcagatgttctggggaaaatacttggccaggtttgtaacaatttcatcagagatagtgctgtttttaaaggtaattacaacatatatctgcatctggacaaggaccaaaaaagaatgcagaagagggaaaaatatctatatgtgttgtgtgtgtgtgtgtgtgtgtgtgtgtgtgtgtgtgttttatacacatatacacatgaacacacataaatgtttagtttcctcttctttcctaacttgaaactatttatgacaaaatagtttacatttatatagcatcatggtcaaagtgctttacatttaataatttatttaatccaaagtggaaagaagctcccttttttaaattaacatcaaagcagtttattttcagggtgggaattcaaatatttgagcatactttttacttggcaagtcattttctcccctaggacagataagaggctattaaatctagcacagcagactgagaattcagcaaatcaaatgacagataaggaattgaaatatgagctgcatatcaaattctgaatttaggcagtttggagaaagaaatgtttcaatggttttaatgggaatttgtgttttaaaagggtgtgttcaagaaatactgggaagaggattaaaaaatagtgacaaaaataggtgaggaagaaaagcacatgattgaacattagaagtaaatgcctaaaatatctgtacttctcagttttacaaaacaatcaatagtaaggtgatatgagaacattctcctttagctcttgctctattaaaaaaataatactgattcagtaacagtctaaatcccaagtgaattttctccactaatgccataaataactcacttcctgcaggcacatcatttttcactgttgaaaattaaaattgttaagtagagtattggcaagagagaaaataagccaagctttcataccttgttcttgttgcttctatatttacgtgtgactgaatttggttggatcttaagtatttggtactgtgtttgtcataactacttgtaaacctatgtcttctagtttagctttaaacattacgcttgtgatttctataaaaaccttcatgttttacaagaaatgaaatgtgttattttatattattttgcctgtgacatggaactcccaagtatggttatttttggtccataagcatgctactcatacagttccacaggaccccatgctaaaaagggccttccactcggttgagtgctctgccatcactattaatttttgaacaagggcctctacattttcattttgtactgagcctttcaaatcacatagctggtctggtatgtttgaataagaagttcagtaacaaatagaccaaagtctcaatctcacccctgggccttgcagccaaatgaacatggaaaagctaattggcactagtgagcctattctacccttatttataacccttatttataaaataaggattaaaactgtctctctcaaaaggctataatgggaattgaaaaaataaaacatttaaagagcctcacaaataaggcaaatacgtttttgttgttgttgatgtttcatttgaatttatttattttttgagatggtgtcttgctctgttgcccaggctggagcgcagtggtgtgatctcagctcactgcaacctctgcctcctgggttcaagcgattctctcacctcagcctctggagtagctgggattacaggagtgtgctgccacaccccaccaattttgtatttttagtagagacagggtttcatcttgttggccatgctggtcttgaatttgtgacctcaggtgatccacctacctcagcctcccaaagtgctgggattacaggcatgagccactgcacctggcctgttttgtttttaatctcaggagccaactccattaaatttgggtggcttcctggtaaacttcagccagaaaagctaacgctaaattcttatctaggcaatagatattaatgtgtataaattaagccacaaattattgggttcatgagtaaaaccttactttgaaaaactctagcttgaactttgcaatcctcactttcctttgggaatgaatatttttatttttccacattctctcctgttattagggcatcaatgttagttcataattgttgcctttttttctgcttaagtgatctcctatcttaataatcaaaacataatttgttactttggagaagggcactcaggtgaaaaatgagaatgcagatataagcatgatgctttgacagaacgccagccattgtcttttagcattggtttcttatgaacaatatttctgtgctatgactggcctcatttgaaggtatgttctgtatgggaggtgaaggacacagtgcttttggctgcagaaatctggagagttggcacagggttttaaatgagggatcaagatttactggaggatctcttccccaagcaattgttgttgctgttgttgttgttgttgtttgtcattgtcttttttggggggggaacggggggagttttggctgtatgggtgagtataattaataaaaatgcgtcgaagactgcaaataaatgagtttatgagagggaagaatgtgcaggtaattgtgtaggctagcccagagatatacccagctctgctctcaactcataaggttttttttttaatcttaattacttttccaaataagcctttctaattgaaaaagtattcttcaacaagaataattaaaactatggaacatgaaagatgggtaattagttagctcattcatatcaattgacagatgaataaactgaggtcatacaatttttagtggactaatgaaaataagcagaaagtataacctatctgaactctaagtctgtgtgagtttaggttcatgaacgagtttccccagaacttaatcaactgtgcactaaataacatagacttttagttctggagggcagaaccagccttgagagttttgttaactacagatttttactgtacactgtcctagtcacagaccacccacccctcttctccggctacacagtagttacctcctcctcatgtgggcctgccagatccactgcagattcttaaatagccattgctgtaccaaatgaaattctatctgagaacctgttttgagggtattatttcttctctacaaccttgtggccatctcacctacactctctaagcctcaattattcatctgtaaatttagcataatgataattatctctgctcagcctccttcaaagcactgaattaatggaaagcttagaaaacatacactgaagcactttttagtgtgctctatcaattgaatattatagtgttcatattggctttttataataggtatactactattattgatattaacacaataatgtgttcaaactattgaaataggattacttaaaaactgcgttaatattcaatagcttaaatctgaattgtaattacttttagaactttatacactaagtgatttctaaagtgactaaaatagggaagaatatttcttgttttgaaggagcataatgatttgcaaatcatggatgataggttcaaagaaaaataattggttgaaaaacaaactgttgggtaccatgctcactatctgggtgacaggatcattcatactgcaaacctcagcatcatgcaatatgcccatgtaacaaacttgaacttgtacccctaaatctaaaataaaagttgaaattattaaaaaaaaaaaaaacaagaaaacgaaacaaagctaaactgagaaatatttaggaatatgtttattatccttgggagaagacaaggagaagctgttggctgtttgatgctctaacaaaattttcatcaaaaccgtattcccaaaatggccttgaaaggcaactacattgactgtcaatgataacagcaggattggacagcatggttgttggttacttacagtctggaaccagaatgcctgagtttaattgctggttatgccacttatcatgaaatattaagcaaaatacttggcttctctgtggtttaatttcctcagttataaaatgaggataatctaattgggttgttataatgagtaaatgtgaaaatattgcttagaacagtacttggtgttttaagtatttattaaatatatttcttaactggtgatcaattagattctattcaccatctttattttatcttgtgtttagttgcttttgaaattagaaaaataaatcaagtagcatgtcatcatatctatacaatacatattttttaaaatgtggacatcattcaaatgctcaggcttgtagaatttatgtatattgttaacaattttaatgattttgaatgtaatcaaaaagatattttgaagaggaaatggattggataattgtgatctgttgattttttcatgctaaaaaatcatgttttttcatgtttttcatgttttcatgttttttaaatgatactgaaatctttgcattaggacaatgtttctcaaaatgtgacccaggaacccctcaggtgtccatgcctatttcagagggttcacaaggtcaaaactattaacaaaataatactaagatgtgatttgccttattcatgctcattgtctcacaagtatatcatatttttccaagattacatgacctatagtattacaaaagttgaatgcagacacagatctgagaactcaactgtcttccattaaaatagtcattaaggatattcattaaattgtaaaacaacaccactctcgttaattttattttgtttttgaaaatgtatttttataaaagtatatgctattcatataaacatgatgtgttagtactatacattttaatgaagtaatacataaatatttttaattttcaaaattttaattctttagattaattattaatagatataactggcttaaacaaaagctccttggcatccccagtaagttttaagaatgtaaaggggtcctggaaaaaaaattaaaattactgcattagactatctgtagtctcttagaaattcatcttgggcaagtggtttaatggagttgcacaagtctgtggaacaaccaagaggtaggcccaacatcatccaggctctccagcccaatcttctctggatgaatggaacaactagcttctgtgtgttgtttctttcagttctagagccgctgatatgacagatggacaggccatgaatcagagagcacaggggttctctgtttagagtcagtaaaaacatgaatttgagtgacatttttcaaccagagctcctgatatttggaagctggcagcaatacatatttaaaacagtatgtaggcacagagagaaagtaatgtgaaagtgtaaatagtcgatgtgatgatactcagagatttaaaaattatatttccattttgaggaaagtagtttttttgtgttgttttacaagattgaattgctacataattttacaagtcatatacatgtgtttatatacatttgatagttcactataattgcaaaaattaatttagcttcccttggaattgagagctgctgggttcaaaatttggcagacaagtacaagtgagcacaggcctacccaggacctcctggttccaaagtgagcacaggcctacccaggacctcctggttccatccttttcccagctgatatggtttggatatttgacccctctaagtctcatgttgaaatgtaatccccagagttggaggtagggcctggtgggaggtttttggatcatagggagcaccatcctcttgatgatgagtgagtttttgctttagtagttcatgtgaaatctggttgtttaaatgagggtggcaccttacgcctcctgcctccttctcttgcccctgctcttaccatatgacatgcttgctccccctttgccttcctccatgattagaagcttcctgaggctctcaccagaagcagatgctggagccatggttgtacagcctgcagaactgtgaaccaattgaaccttttttttttcttttttgagatggagtctcgctctgtcgcccaggctggagtgcagtgggacaatctcggcttactgcaagctccgcctcccgggttcaagcaattctcctgcctcagcctcccgagtagctgggaccacaggtgcccaacaccacgcccagctaatttttgtgtttttagtagagatggggtttcactgtgttagccaggatggtcttgatctcccgacctcatgatctgcccacctcggcctcccaaagtgttgggattacaggcgtgagccaccgcacccagcctaaaccccttttctttataaattacccatcctcaggtatttctttatagcaacaaaaaatggcctaatacatcaaatttctaatattagcaaggaaccattcccgcagagttggcccagtttcccagagccattccctcattcaggctgtctcatatttggttatattagcctcagatgttgaccagtaattaagcttatatttggttctactctttacaacatggggattgctggcctacgcattgcaagggagactcacctcctctctgcgttaccccagtgctttcttagcacccagactctctgtcagtctcccttaactctgttctctcccagatcctgcttggaaaattgccgctgttcatatcaattatttttcagaaaccatggatgcattaccaaaatgtagataagaaatggtaacgaaagcacaacccaaggcattcattatgaggttagacagaacctctttctttggatgctaaagcaggcacctgggaaaaacaaaataccaacccaaaccctgaagaaatgtcactaattaattgaaggtgtatcactcaattcagaattgagacatctccagctgcattttcaaccagatgttctttcaggcatgtagtgtcactactagagagaaacttcaacagtcctgattctcataatgagtctattgaaatatcaggtgggaagccttccaggtgtgagatcacattgctaaaaaactggtaatgaggggcaattctgcttcatttcaatatttatatagcttgttaagggaactttctactaaagacacccctcggagtctaaaaaaaaatgcattaagtaggtggacaggggctttgattttccctccctttgaggggaggtaaatgcatagttccacaagcttagaatacaatgaatcaggtaactgagataatattatcttctgcactcacactaccacaggattcactttttcatgtatcatatatttgcaatttcccattgactagggtaattggcaattcctgtgagctaacttaaaaatctgtttttctctttaactaaaacatagtataaaatcaggatcaaatatctgttctgcaactgtggaaatggcttatttccagaaatgtttaggatgtataatagtttgtacccagatgtagttatagaacagtcactgaaaaatggttgttttcttgcatattatttcaacctcccacccatgttaattgccagtgacattttgggttgtttttcaatactttaatgagaactaaagcttctgaaggagtcttgctgtatctaccatctgattgaatttgatgtcccaattattgatgtctttgccagtctgtgaaggaaacccaacctccaatgggtgaagtagcagctaggttaggcagatattttatttaatttttagctctagcaaaacttaacggtaatgatcaagaatcttgtaagtatgaagtattaatcttgaataggcatgtttgtacagagttcatgtctctgtatctgaagacattagcccctagggtaatttattatgagacacactgaaatttaagttgtataaaaacaagttatcggaggaagctaagaaggcccctaggtggagcagaggtactaaaccctcagcttgataaatactgaggagggaaggtcattacaataaatattgcctactcaaaatgtgatccatggacctgtaggatgctgtagcattggcttctaccacgggcttgttagaactgaatctcagtccccctgctccccacagacctactgaaccagtttaacacattacccataagatttatatagatgctgcaaaactccattaacaaggggttgtggtgcacctgtgctcagcttgggctgtagagtaccagctggcatgataagtgaggcagctgggattctgattctgacactgttgatgctcaacatcaggtagggaccaggttggtgtgccacctagatcttgcagtttggaaccaaagatttcaatgaattgccaaggtgttgggtgcaaaggaagtcagtatcaaagaaagagaggttccatccatgtaggggccacactatggccaagaacgctgtcaggctttagttcattaaattcagggctacagaccaagatgaatgagtcattgcccattccatcaagacatcaggtgattaaaacatcaagataaaaatggcctcaagacccatccacacaacatgggttaaggcaagagtcctggggtttccctgaggcacatcagctgtcagtcttggggaccacatttcatattcttttcactagtgggaaagggtttctcaggttctcctgagcatacggcccgggtgacgggcttccattgagttcttaaagcctagaagacaaggattaatgtcccaacctattcagtttaaagtggaggagtgcagcaaactcaatccaaaaaataatatccctaagaaacagtactttttgaaggataggcatcccaaattgatattttcatgaatgaaatggggaaaaaatgataatgatacaaaatactaatgcaactgtgcggtttaagtgcagtcaaacttggcaggatcccatgataaacattcatagttttaatggcatctaaactgtagtaacaatcaacgagttagtaaagcttgaaattagtaaactcaatttgattcagagtttgtggtgagcaattctaatacttgtgtgttcttaaggaattacctttgaattttttcttttaaatatgtcaaggtcttaatagtattgactttctttgactgtattatctctttgaacccttgcgtcaacactgttaaataaataatcttagccttatgtttaaaattaggcttagagaggttaagtaactttcccaaggccattcagtaaagtacaactcacaaaaaccttctgaaaattttccaattgactctgtctactattccccaaggattttgaatctcattacttaggcctttgtgagttatcaaatcttttaagcaaaaaggttttctttcttcagtcacttattcattcagttacttctatcttacagggcctggggacctgtaggtaaaaaattgtcacaaaacaatgtttctttagctttgatcccattctgcagagaactctagtttttctccagtgccaacaaagcatttctgggaaacaccagaggttttatcctttgtattctgaatgaatcccatttgctaccacagattgtgtgacatttctttccttttatgcttaggttttctgtggtcactgtggattaataaggataaacaaaacttccaaaataaatacaaacaaacatgtaatggctcagtgaaacataagattatttatttctccctaatatagttcagagagcttccaggtaaagcagtgggcaggaagataggggttctctccacatttattaagggattctggatgatgtcagttttgccatctttaatgtgtgatttttaaggtcttcctgagggtcaccagtccaatcggctaaaagaagagaatatgaattgagtacatgtggggaggttttctggggccaggcctggaaatggtacagaggatgtcctcttacatttcactggctagatctcagtcacatggcaaacaatttctaggcaggcaaagaaatatggtttgccttgtgcataagaagaggaggaaatgcatttttcgtgggtagcttgtactctcagtgagactactcatgtgccaaatggaagccatggtaccagcacatagcagaggcagtcactgccactgctcatgtttataagatcatttcccctgctgacagtcatcagccaagactagaatgcccacattcaatgaaaatgtgaccctcatgcagctatctatgctgctgactccatgcctctaccatgttcagctgagcttgtggagattggaggaaatagacgattaaatgttcactgctgttttactaaagaccccttgcctggacatatatctaaatgtgtatatgttgagggattgtcagctgggacaggggtttaaacccataaaagtgttctgtgttgtcctccaaatcatgcttcctttctaatgcttgggtgaagcagctttggctcagacttagacacttgcttaatatcttctaggtacttgaagagcttatggcccaatgggactaactgatgcatatacaaaaaattacacaatcaaatctcaatttcctactgtttattcttcctttgttaatttctcactctcttagtttatttgaattctgctaccagtttgtctgtcccttccctttgaccctgttgtttgcactgttcttagagtcaagatttcagtgtcatgataaaggaccagctcatcacataataagagttgtaagagtagtgacccaagaacatataagggggaagttctctactgaagggtctgtgaaaatttgttgccccatggggctggaccaaagccttgctattgatcttactgaacaggtcactgttggtcaggaatgtgataaaaaggctgcagttaataccaacaaacaaatattatttgtaacatgagctcttgagattatggtagaaatgtcacagtctgtatttgcatttgattataggagctacctttatttataaagaagcatgctgtagtgagaattctttgctaggagtcagaattgggttcaagttactattgaccacacttccagtatgacctcaaagccattaattaacatttctcggctcatttttttttctgttaagatgttgaaataacacctacttcacaggcttaatttaagaatgaaatgtgataatatatacaaaacacttagcatagtgatccattatgatctctgttattactatcaataatttggaaaaaatagatacctacttttaagaaataccttcatttttgttttttattagccatgtaaataaaactatcaggtattaaatattacatactgacatatattgaacatatatgtctgttttaatacatatatatttctttaatatatatgtgtatatatatagttctttgtttatttttagtactgatgattctattataaaagttgtagacatttcatttacaagtcattttagacctttaaaagaatattttttaagaatgtgtaaaagccagactttctttgactagatgacttttattctagaactgatttttgttttatgtcagactcaggacacatttgatttatccttaggttgttttctgaggctttaaagtatcagagctgagtggaaaaatacttcttggaaaactgattttccaactaagaaactcagagtgatggattgctagaataatggctgtaatatatactgagaatacaaaggagatatgtagtctcttcaagatgaatttgggttcataagaagtgagtctgtgttttattatctttctgcatataagaaaactcagactatatcatttctgcacaaattcatggtagcccctgtctagcctatccagttttaatatggaacaataaataatataaagaatatcatggtaataagttttttgtgttctctaatccagaaaggcattgttgccataacaagttttgtaattattggagaaaagtacaaggatttctcaaaaatcatttaaatggtaacatttaaatgttaagcactgctaagatgaacctaaaacaaatatttaaatatctctattgttaatggttattttaaaaaaatttctcatccacactactggtgcttatagatactatagccacaaaataggtaatactaccattatgctaatctctttgaatacattagtttattgaatattttttatcttttacaattatttcctacatctagcaaagatgtctagattctagctgtagcctcttgcctctttctccattcctgggtcttacttatatacaatttctcttcccatggccctcagaaatttttttttagacccctgcatgttcttactttctggctgcatctgctcttatatctttttttaaataaggtgcctttggaccctaccatggtatcatggtcatcgcctctcaaaaaaaaaatctgcatttgatgtctttgacaatagaagaatgattgtatgaaatgaatatccaatttatttttctttttttcattttcctttttatttatttatttttattttttagagatggggtcttgctatgttgacaaggctggtctcaaactcctggcctcaagtgatcctcccatttcagcctcccaaagtgctgggattccagatttgatccaccatgccccacccaatttatttctcatgattccaaagtttatgcatagatgctttagctgaacaatagttccttctaattgaaaagaaagcctctaactcagctgacatggaacagtctcctgcatgtagtgaacttactcactacagagggattgatgctttcagagaatgacttaaactatgacatgctgtgatgagtatatcctcaagctactacgacatgtttattaacctctgttacccaattaggtgcaacattgatcagaacctgacttcaatagttttgatacttagtcttttagctctgactgctttagagtataaggtccttgaagataggattaccaccttataaaacagagttgcacaacatagcatgttagaaataggttggggccaggcgcgatggcccacacctgtaatcccagcactttgggaggccgaggcaggtggatcacaaggtcaggagatcaagaccatgctggccaacatggtgaaactctgtctctactaaaatacaaaaagattagccaggcacggtggtgggcgcctgtagtcccagctactcgggaggttgaggcaggagagtcgcttgaacccgggaggcagaggttgcagtgagccgagatcatgccattgcactccagtctggtgacagagtgagactgtgtctcaaaaaaaaaaaaatagattggaacttttagtcatattcgttcagcttgaattctagttcactagttgtttgcttttgggcaattcatttaactgctattagactagccaactagggacagtttttgttccttaagtttccaaatggttgagaggctcaaatgagaaaatagtgccaatacagttcattaattttatgattgtttctggcatagaaggaaatgaaatatttaataaataaacctatgagtgaattgatgaattaatgagtggtattcaaattatacttttaaatgtatgtttaaatacatgtggcatcccatttcctaggcctaaatataatgaacatgcttgcttgcaaaaggagccttttgctaacttcccagagagtctcatacaatcagtcagagacaaagacccggtagccgcttcaggagcctcgcatagcaagtgattcctgttgttccactttgtgcttaaagcatgagaagttgggccagagtagaattggaaatggaggacctgtaggccaggctttgcttttaggggacttgtgattggcaattcgttgcagataataatgagaagaaggcagaagattttaatgaggcacgcatgtgagaacctcagagactctgggtaacttcggtgtctgcaaagtggctactccctgtttctcaagataagaggggaaggtttttccatttcaaactggttgggctcattttggtcaggaagagtcttggatggagaaaaaattccagccctgaggaaaaggcattcagcagtccctggtagtaaggtaagggttggtagcttaatcaactataggccacacagaacaacaacaaaaaaggggctttagcggtatgtttttacctagtaaaagaaataatttcacttctcctctctaccactctctttaaaaactcatcctcacaggtgtatgtaagacaatctgagagtggaggccagtgttttgcagtgcaaatccggcagtatggcttgctttgagaagtctatggcaatgctccaagggaaaagactgcaaaagtcaaaatataaatatattcagtgacttcagatcccattgtttccaggtcccttttgctttttccaattacctgtctcatttttgaggaaactttgcagtgcttttccttttattgtcattcttccccccaccctgtggtttttctaacacctgcactgcatcatccttcaagacccttttggctttgtttctgtgcatgattatctccccttctccctccttaccatatgcgttttaacaaaaccaattttcagtattgagttgaaaaaccctaatttaaagaagtaaaagagatcttcccaaattttaagcaaccgtaaagaaccagctggaaatgtatacatgtgtgtatgtttgcatgtgggggagcagtgaggatgatctctagagatagattagatataggaaggatttggcaatatacatgaggttagcgtgagaggaaggtaagtttaaatttacagtagatagccatttccaaggatgtattagaacaaatgcagaatttcagaggaaagaacagataattatttcacggcccttgaaactccttgcacatttctagcttgtaaagagaatgcagattagctttttatccatacagtaccttcatctatcaaatatttctgtctttataaacctacaaattacatacatacaggtctgggcttctgggtgaattagaagcaggggcaggtttcctcataaaacctaactttgtcaccaatttcatgtaatttgctactaaactgtgcttcttttgctttttatctctcttcttatgtgctcttaaaagctacttgctggccgggagcagttgctcatgcctgtaatcccagcactttgggaggccgaggcgggtggatcacgaggtcattagatggagaccatcctggccaacatggtgaaaccccgtctctacgaaaaacacaaaaattagctgggcatggtggcatgtgcctgtagtcctagctactagggaggccgaggcaggagaattgcttgaaccagggagtcggtggttgcagtgagccgagatcgcgccattgcactccagcctggtgacagggcgagactccctctcaaaaaaaaaaaaaaaagctaacttgctttaatctatgaccgtgaccttacaatgtactttataatgcatgtaccttgatgataacatgtgatttgtgatctttctaggctgacaaatgaatctcctagagctctgctgtgttgctacagtggtctgagtcattgtgattagaaattatttaaattcatcatttttatagacaggcctgaacaacctagcagagtttttttaaaaaaattttactcaaaattaaatatcttattttgaaaactgtccttgtactataatagctagcagacgcttcaaatatttctctttcatgtagacaaatctatacatttctcctcagagaatatagatgtcaatgcctgcagataagcaatccaaataagtttaatggaaggcagttttatgtaattaagttgtgacacttttctgtgtggaggaaggcttaaaaggaaggaaaacaagccacaaatgggagaagggcaatatgcacacgaaggttgtgcctgtggaattgaacattccttatctatcctttggttcttcaaatagttcatatctcttggacacatgacattgagaagtctggtaaaaaagataaagcctgccatagagtagcaagagaaccaagcaaatgtaatgtcacagaagccaagaggagacaatttcaccatggagggatagaaggatggagtgattgtctatatcaaattatgcttagaaaaaagataagaacaggtaagtgaccctttgctttgtgaaatactgtctctggtgactttgataagagcccttttattggagtggtgagtatgaaagtccagttgaaaatgatgagaagaggccgggcactgttgctcactcctgtaatcccagcactttgggaggccaaggcaggcggatcacctaaggtcaggagttcaagaccagtctggccaacatggccaaatcctgtctctactaaaaatataaaaattagctgggcatggtggcgcacacctgtaatcccagctgctcgggagcctgaggcaggagaattgcttgaacacaggaggtggaggttgcagtgagccgagatcataccactgcaccccagcctgggcaacaaagggagactccatctcaaaaaagaaaaaaaagaagaaagaaaatgatgagaagaagaaaactgaaggtcagtaggtatggcagtgagtataatcaaattagtcagggatttttttctgagaataattgagaactaaaatagtggctacagaaggagacaaggccagttatacatatgggaggacaaaagtgaatatgtgggcttcaaaaggaatacacatttatttttcattttaatattagaaaaataggtagagataaatgcaagttggtggaacttgtggtggaaaggtgaggctcttttcttagtcatggatgcagctacgtcattagcagagaggagaccaaatagcagctggagatttgaagaggggatgagtgatggaattgtcatctcagagagttttaacgttcaaaccaagtataaagtacattaggtacaaaggcagtagacataaatttgtaaataagaatacttagagactataaagaactaatcaggccgggcgccggggctcacgcctgtaatctcagcactttgggagaccgaggcaagtgtatcattgagttcaggagtttgagaccaacctagccaacatggtgaaaccccgtctctattaaaaatacaaaaaatagtcgggcgtggtggtgttgcacgcctgtaatcccagctacttgggaggctgaggcatgagaatcacttgaacccaggaggtggaggttgcagtgagatgagatcatgccactgaactccagcctcggcttcagggagagattgtctcaaaacaaaacaaaacaaatcaaaataaagtgaaacaaaacaaaagaatgaatcaatccaaaccagaaatgacatggaaagtagtggtattagaatgatattaagcatcagttccttttaaatgtagaactaaaatatctcagagctgtccaatgtaatatgaaaatgctctctgcattctctacttataatacttaaaaaaatagtgatattcaggtgtcctctgatgattaccatatttctgtttacatgatctaattgattgttaagcatctagtataaatttgttgaaatttttgacttgtggatggcatacttcccttattcccagcacagatagagggcttgtcttatttttaagtgcctttgcctgtttcaatagctgtaagtatcagggggaaatgaacacagctagaaatctgcactcaagtgttcatcctgccagtagttgtcatttaaatcaatgattagattttatcttattgacgacacatattaacatgtataaattctgaaaaaaaatgtaataattacaatttccttaccctatttcaaacagctgaattgttttaatatactattatagtcctttttttggaatatattgtattgtatagttagacaaatttgaattataaataaaccagtatcttatttatttatttgctattttttgagacggagtctcgctctgtcaccctggctggagtacaatggtgcgatctcagcgcattgcaacccctgcctcccaggttcaagtgattctcctgcttagcctcccaagtagctgagattacaggcatgcaccaccacactgggctaatttttgtatttttagtagagatggggtttcaccatgttggccaggctggtctcgaactcctgacctcgtgatcctttcaccttagcctcccaaagtgctggaattacaggcctgagccactgtgcctggccatatctcatttatttttattttttttaatttttattttagatttatggggtacgtgtgcaggtttatcacaagagtataattgtgtgacactgaggtttgagcttctactgatcccatcaccaatatagtgaacatagaacccaataggaagtttttcagccgttaccccacatctgcctcccaccccttttggagtctccagtgtctgttgttcccatctttatgtccatgtgtacccaaagtttagctcacccttataaacaagaacacacactatttggttttctgtttctatgtcagttcacttaggacaataaccttcagctgcatccatgttgctgcaaaagatatgattttattcttttttatggctgtgtagtgttccatggtacatatgtaccacattgttttcattcaacccaccattgatgggcacctaggttgattgtatgactttgctattgtgaatagtactgtgatgaatatgctagtgctgatatctttttggtaaaatgatttagttaacattgtgtcatcagtattctgagtttgttcatacacttagtaatcactactgatatttgtaatgttgaatataggtttccaatttgtggctatcacaaaaattccaaaatgaatgttttcaggcaaataactttttcatgttggcattgttctttggttagatttttcttttcagaattgggagtactgaatcaaatggcatgactattgtcatgcttttaatgtattttttcaaagtgttctccaaaagctttgccatcttacctctactggcaatctattagaatcttaattttattatatcaatatcagaattggacatttggatgtatctgttggatatacaaggtattcatttcatctttgtccttaatttctcggtggaccttcccactgtctgctactgtaagaaatgcattttttaaagtatggtagatagagtgtggtggctcacacatgtaatcctagcactttgggaggtcgaggcggaaggatcacttgaagtcaggagtttcagaccagcctgggcaacacagtaagacaaccatctctgctaaaaaaaaaaattatttatatatatataactatatatacaaatatatatatataactatatatatataaaactatatatatatagttaactaggcttggtggtgcatgcctatagtcctaactattctaggagcaaagatgggagggttgctcaaatccaggagttggaagctgcagtgagctatgatcatgccactgcactccagtatgggtgacagagtgaagccctgtctctaaaaaataaataaacaataaaaaataaagtggtttgaacttagtatatgcaattctttttaggcattttgttattaaccaaggattaaatgtctagtccacagtcgactatccgttttttgaaattttcccattaatatgtttcttctctggcctactgggtttgcaaagagatttgtggtaatgattctatgcctgcattcttgatatcatgttctgtatcccatgcttgtttaatattcttactggaggtcaaggaatagcataaatttcttatcacatcacagtataatgctgttaatttcagggaagatgtaacatactaactgttaaagaatgatcctctacttatagtatgagtggaaattcttatacatagattatatttattaaattattatattattttcaatatactcttagctttgaagataagtaaaactcaattaagacctagactccaccacttcctagcttaaatagatatttgtaaaattatccaagccaggaaaaatgaaaatatgaaaatgtatgaaatacaaaatctatgtccacctaatatgtttttttgagaattgaatgagatcatatatgaagacccaagcgcagttcctggacacaataagtgctcaataactattagttatctggctctccattctcttgataagaaatggacaaggccattctcatatcacaattctgggatacacatgagtgaaatcctgcatcttgtcagccaacacaccttggccatttgttactggaggaggcctttggaatgacaggagggcataagagtttgacaatggttctgcaatgcttgcctaaggagacaatgagactcaaccaattccagtttgcatgtggcaaaataagttaaaaagttgaaaatttgagttgatgaataagaagtagaagggcagtcagtctaacaaattggtaaatgtaactagccctttgggtctaatgttggaatctggtacttggaagatgtgttattgttttgttatttgtatgtacattattgttcttccctgattcagtaaattctgtactagctatggtaagtgaaacagagggaaagcattggtgcaattttgccttcatgggaattagcctacttttggaggctagcttgaggtgtcattgggaatgtggctgctagagccccactctcgggaggcaaaatcagtcacatttatgtaactgaccccaaatcaaaaacagttactccctcttttttattcaaaccatattgtatcatgagtaaggttgcttctgtacatgtcctagaaagatactcctcatttgtatagtcacaaaggcaagagtctcaaaactggtcatctttgaatatcacttaagctttcttttatggactaggaaacaattgagcggaaacatgtggtcaactctaactgtagtgcagtcagaaatcccagtgtccacatttcctgcagggtctgccctagtactttccttttacttatgaccacccacagtttcacctttgaaagccaatgtttggtgtgcaagcgtaagcttaagagaaagaaaaagttgatgctataataaatttatttctgaaaaaaaaagtctcaggtgaagttatttttagataatatatttacttgttattcatgtgaactgtgttaaaaagttgcttttatgtaggattaatttaaatagaatacttggataaaatagataaaaataaaggcaaaaaacttgtcttttctctatacacatggcattggatttcatacaaatgttatgtttgaaatgaaagaatatatttaaaaaataatagcctttttaaagcaattttaggtgtatggaaaaactgaatggaaaacataaagagttttcatatgacccttaactgcctatcggttttccctaacattaacaacttgtattagtgtggtgtatttgttataattgatgggccaatataaaaacactatttttacctaaaggccatagtttatgttaaagttaattatttgtggcatacattctatgagttttgacaagtgcataatggcatgtgtccaatcatacagactaattttactgcctccaaaatcccttttgttccacctattcatccctctctccttccccctgaacccttggcaaactgatatttttactatctacatagttttggttttttccagaatgtcatacagttggaatcatataatatgtagccttttcacactggtctctttcaccttgcaatatgtgtttaaagtttctctatattttttcatggcttgacagcttatttctctgaataatattccgtcgcataaatgtgccacagtttgcttatccattcacatattgaaggccattttggttgctgtcacattttggcaattacaaatacagctgttatacacatttgtgtacaggttttgtgtagacaatttcaaactcatgtttgtaattaccaacgagtgcaatgtttggatcacactgacactatttgacttgaggacatgctatgaagctgcaataatcaagacagtgtggtactggagaaataagagacaaatagatcaataaaacaaaatagagaaccaagaaatagaccacaaaactatagtcaactgatgtttgacaaaagagcaaacacaattcaatggagaaattatagtcttttcaaaaaatggtgctgaaacaactgaacttaaacaggcaaatttctttttcttttttaattttcttttttccatgagctagtgcagatggcattgttttaatttcaaatccctattgtttattgctggtgtataagaaagcaattatctttcgtatattaactttgtgtcctgtaactttgccatagttgcccaattcacaaatagttctttactgaatcatgtcatctacaaacacaggtttttctcctcaatgtgtttacctttcttttctttctttttttcttgtgtcagtggattaactaggaccagtacattgtggagtaggagtggtgaaagcatacattcttactttgtttctgatcttagtgagaaaacatgtaatttctcatcattaagtatgttgttagctataggatttttttgtagatattctttaccagtttgagaaagtgtacctctagtaaaagtttttgaggttttatcatgaaatggtatgataaatattgttatcatatccattcatgatgttgaatagtgttaaatgctttttactgcttttactgcattatgatataatcataagattttttcctttaacccattgatatgatagattacattaacagattttcaaatgttgaactagtctcacataccagcaacaaataccacttgtttgcggtatagaattcttttactacatcagtgggttcaatttgctaatatttttgataatttttatatatttgtaagaaatattagttcatagctttcctttttcataatgtctttattgtgttttgatattagggtaatgctagtctcacagaatgagtgagaaagtattccttttgcttctactttttgaaaaatattatagagaatttatgagaatttatatttcttaaactagtatttctttaattggtattgcttccttaaatgtttagtaaagttcaccagtgaatccatctgagctggttgctttctgcttcagatggtattaattattgattaaattcctttaatagatataggcccatacagattacctatttctccttctgtgagttttgacatagaaattttcacaatactcatttattatctttctaatatacatgggattataatcatgacctctctttcatttctaataatagttgtctttctttttcttagttaaattagctaataatttatcacttttatgaggtttttcaaagaatcagattttctctgttgatttcccattgtcactttcatcaacttctgctctaattttgtatatgtcttttcttcagcttactttaaaattaatatgctcttcttttcttagtttcctaaggcatgatcttagactattggttttagatttccttttattctactatacacatcaaatgctataaatttactgctaggcactgcctttgctgaatcttataaattttgataaggtgaatttttgtttagttcaaaatattttaaaatttcttttgagacttcttctttgactcacgtgttatttagaagtgtggtatataatcttcaagtgttttgggttttccagttatctttactgattttcaatttaatttcattgtgatctgagagaatacttcacatgatttctgttcttttaaatgtgttaaggtgtgttttatgatccagaaagtgatttatcttggtgaatattctgtgctgtcttgagaatatgtattctgatgtgattgaatgaagcattctgtagatgacaattagatctagttgattgatgttgctgttcatttaaactatgttcttactgattccctactgaaaacaccagcacaaggttaacaagaattacaagcctgactttaggaaaaattagagtcaggcattggacagggtgtgctggtacactttgacccacttccctgcagctgctgcataacccagagtcacatagcacactaaccacctgctccttcattgttcctatagatagaatctctgacaccgaacatttttacccaaaaattgctaaaggtgttcttcatatcctgaatttcagcagaacagcagacaccaagcaatctgaaaacccccaccaaggaagtgactcagcaccaaaacgttgtttcttcatctccctgtcctgtgacttcattcctcacttcttgaccaatcagcaatcccacactttggcccatcacccatctaggccccttaaaaaacccatccccaaacctcttggggaggcagatttgaggttccctcctgtctccttgtttgactgtcctacaattattaaacgctttctctgctgcaactcccactgtttcagtgtattggtcagttactgtgcaatgagaaatcaaatctggaggtcctgtaacactatctgccatatctatcaataactgttagaggagtattgaaatcttcaactataatagtggattgatacatatttttatagtaattatattagtttttgccttatatattttgacactgttgttgggtgcacacactctaaggaatatatgtcttctcagagactttaccccttcttcattatgtaatgctcctctttatcactgataattctctttgctctgaagttgccttgattggaaattaatatagctgctccaggttgcttttgattagaattagcatggtacatttttctccattcttttacttttactctatctgtgtccttattaagtggacttcttatagacaatgtataattaggccttttttccccactctgacaatcttagtattttaattgatgtatcaaacctttgatatttaaatgatgatatagttggattaatatctaccatatttgttactgttttctatccattgctcttgttctctttttttcttctttctttctttttctgccttctctggttttaactgagctcataatagagttcattttcttcctcctctcttagcatattaattatacttcttttttcctgttttctgtagtagttgccctggagtttgcaatatacatttataaacaatccaagtcctatttaatataaaacaataatatttttttgtattgcaagtactttataacagagaagtcccagtccctcccttctagcccttataacattatgttcattcatttcacttttccatgagttacaatgaccaaatactttgccattattatcttgacaaactttaacctgacagatcaataagaaaaaggaaagattttatctttatgtattccttttctaatgctcttcccttctttttatagatctcagtttctgacttataccatgtaagtttcttgcaaggcaggtctactattaatagcaaaaaatttcttcagtttttgtttgtctaagaaagtcttaacttttgaagacttccattctgaataacaatgtcattggatacagattttagcttggtgggttttttgtttcagcactttaaattctttcctgcacagcttctgttgaatgtagaagagaaatttaatgtagtacttatctttgcttctttttatgtaaggtgtatcttgcttttttcaagatttttctctttgtgtttaacctcctgtggtttgaacttgatatgctcccgtgtagacgtctgtgtctttctttatttttatctttcttgatgttccctgggctttctggatctttgattttgtttctattaatacttctggaaaattcttgattattattgttttaaatatttccttggttttgcctctcctgctatacgaaatccctattgttgtggtggtaaattgtttggggagggaaaagttaggtttataaccctatggttagttaccattcttaaagtgagactgtgtctctgggctgtcacttctacaatttgttctcaacccctcttcccttttaggtgataaaagaaggctggagggagctggagttgggtattgcccttcctccaggtcagttaggctctggtaaaatagtttgtcttaagggtacgccttgttaagcataacagaaagctctgtgtatttcaaatggctacttcccctgccccctgactcacacacacaattagaagcaccaacatatttttctttaaaaaaaatgtatcacccctccccctcaggactgggcctccctggtgtttttaactctcaagcttgtccatactgagccttgaataatttgtcaattacagtttaaatgttcctaccctgatagccctcttgattttaatttaaaaagaagaaaagtactgtacatcattatataataatgtctcccttctttctatgaagagatctcataatcctttttttactaacactttaccatatgtgattgacaaatttatgacgttagaaaaggaagacaactttgaatgtatgcaaagaaagatttggagaatcaaagtaacatattcaaaagcatcactaataagctttgttagttccttggcttttgtttgtaataattttgtatttaattagaaaataacgtgattctatccttgataattgagtaaagagccattcaaagagtgccaatctatggaccaggttttgattagcactgatttggtatgtagctttattgaacttagcaactcttctaggcaagttcaaggggcctgcttacctctgtctgtctttcaggactacaatctattcagaggaaaatctcaccttttctattttacaattgctgaagtgtcattttctgtatcagagtaatggtgctaatcaattgagaagatcacaaaactttggattcaaacattaacaagttatattgtgccaacagattatattttccaaaaaaaaaaaagagagagagaaaattggaaaaaaaaatagttggaaaacatgtgttaaacctcataatcaatctggtaatagaattttcatgattgtaccaaaccttatttcaatgaaaagccaatgtaatgtaactacattaacattcaattattctttattcctcatcgtaaatttagaaaaggtcaaaagagtaaagaagaaagtaaaattaatgttatcccacaacccttgtatataatattagttttccatttatatcacaacaaattaccacaaatttagcaacttaaagtaaaacaaaattattgtctcatagacctttaggtcagaaatctgggtgtacttggctggtttgtctgcttagagtctaccaaggctgggcttttatctagaggatctggaggaaaagctgctcccaggctcactcagcttcctggcagattcacttcctgatggctgcagggctgaggtccctgtctccttgctggctgtcagccagaacctctctcaccccatcgagggcccctgtattccatgttatatcagcccctctgtctccaaaccagcaaccagggcttcaaaccctcctcacgcttcaatctcttctgcctccaatttcagtaaaagcgtagacttttaagtgacttgattgggacaagctggacaaactctctactttaggatcaattaattatatatgcagagaccctcttgccgtgtaaagcaatattcacaccggtttcagggattagagtgtggacctcttcaggggaaccattctgcctgttatcacattttaatgtccctcaattttaggatgtttaattcattaacatataattcctttaaaaataggaattatactggatatactggtttgtaattgactttttcatgaaacaatgactggcatcgctgcatattttaatataatgtgctcagtgttcattattgtccaagtgtcaagcccactgggatgctcttggctaagagtgaagaattccacataattttgtacccctaatacttaaagcacaaaaattcagaatgacttagcatcttaaaaaatctggaagatttagtgttggtcatacaaagtcacccttactcatttgtattcttcttactttcttgagaagagacaaagacctaaggtctcattccaggagttatgtatgactttgatctgaatgtcattcagggtatacatcttgagaaggaaaagattgagaagctttgctttactctaaactgagatatggtttttaatgactgtgttgtattcaattatgagaaaggacaaatattttaaccaaatctatattttggaaataattaataatatttggtaacaactcaatatttttttgaacatagatccttggataaggccaaaatataaatattttaatgattataaatatatactatgtagctgctatctagaatgaatattctactttaaattctcactgattttatacagaaacacctattttactctgtcatctccataataaatgatgaacatactttaactgtaacactggcagatgtcttttaaagatatttggtatcttaagtagttatttatccttagattgcaatgagttttcatcgaaactgaatttttcttcttttaaaattatttttttatttttcatttttattttatttatttattttattatactttaagttctagggtacaggtgcacaacatgcaggtttgttacataggtatacatgtgccctgttggtttgctgcacccatcaactcgtcatttacactaggtatttctcccagtgctatccctcccccagcccctccacccctggacaggccctggtgtgtgatgttccccaccctgtgtccatgtgttctcattgttcagttcccacctatgagtgagaatatgtggtgtttggttttccgtccttgtgatagtttgctgagaatgatggtttccagcttcatccatgtccctgcaaaggacatgaactcatccttttttatggctgcgtagtattccatggtgtatatgtgccacattttcttaatccagtctatcattgatggacatttgggttggttccaagtctttgctattgtgaatagtgccacaataaacatacatgtgcatgtgtctttatagtagcatgatttataatcctttggggatatacccagtaataggatcactgggtcaaatggtacttctagtcctagacccttgaggaatcaccacactgtcttccaccatggttgaactaatttacactcccatcaacagtgtgaaagcgttcatatttctccacatcctctccagcatctgttgtttctgactttttaacgatcaacattctaactggtgtgagatggtatctcattgtggttttgatttgcatttctctaatgaccagtgatgatgagctttttttcatgtgtctgttggctgcataaatgtcttcttctgagaagtgtctgttcatatcctttgcccactttttgatggggttgtttttttcttgtatatttgtttaaattctttgtagattctggatattagccctttgacaggtgagcagattgcaaaaattttctcccactctataggttgcctgttcactctaatgatagtttcttttgctctgcagaagcaaattcttaacgttgtatgtcttcctttcttccttccatcttgccttccttccctcattcattccttgatttcctcctcctcttttttttaattgcttttgtttaaaaacagcatagtactatggttacaaagtagatagcaagatccagtaaaaatcaatgtgatgttaaatttaaaataaatttgctattattctggatccccaaaataacaatattatatgtgactttataggaatataggaatgctttttgaattagcagaaaaacatatggcattaatgtgcaaggaagaattatgccacatactctaaaagttctcaaaattgatatccatgaatctttttatctgtgcagtttaaaatgaatgtctttttttcttttgaaaattattttactgagatatattgattttatttttgaagtactggagtttcccaggttcctttaaactttcttcttagatttgctacaagatttttacactgtcatatttttgtaatgtacacttgaaatacatatgcaatgttgttaagtctacatttcttgttttgagaatttgacattcaaaatatgtattagtgttctaaaatatgtttctgcctccaaagccactgcttagcatggctgggtgttacagaaaatgctgtgtggctgtgaagtatgaagcattactaatatctcttagaatataaaatgaatttgttttctaaagtcaatgtgattctaggtcctcagaatttttatatagctacttagatgacagagttgtagttaatagtttgagaagtaggttttaatatctgtggtattgacatagttgttactcagtagattacaaaaaagaaaaatcttgtatccaattagaaataaacattctgtaagaatataacttcccagttagtcttgggagatggcagttcaagaagtactttgtgaaatattctaaaggattaacatagttcatcattttatgcaatggcaatacatatattatacaatacattcctatttttactcatgtagttcttcatataatgcatctaatattttaagggcttatatctgtaatttgactaggtcatttgtttagttatatttgaattttcagacaatcattaaaaaattgtggaagggtcactgttttattctcttattattttaaaaaaaataattaattaattaattatttattttttccatccagagtaattttgttttaaagttgtaggatgataatatttttacatctgtcacataaaattaatatttttaagcaatgtcacattttgaattgtattacaagtcaagaaaagatgttattattttaacacatgatattttgatattatcccaaatagatacagttgtgatattttcatagtttaactataaacatattttaaagtgccatttatttttattttattttattttattattaatatactttaagttttagggtacatgtgcataatgtgcaggttagttacgtatgtatacatgtgccacgctggtgtgctgcacccattaactcgtcatttagcattaggtatatctcctaatgctatccctcccccctccccccaccccacaacagtccccagagtgtgatgttccctttcctgtgtccatgtgttctcattgtttatttatttatttttgagacagagtctcactctgttgcctaggctctagtgcagtggtataatcctggctcactgcaacctctgccttccgggttcaagcaattctgcctcagcctcccaagtagctgggcctacaggtgcccaacaccatgcctggctcatttatgtatttttagtagagaagaggtttcaccatgttggccaggctggtctcaaactcctgaccttgtgatccgcctgccttggcctcccaaagctctgggattataggcgtgagccattgtgcccacctggggcactgttactttaacaacagaccatgtggaccactttgttgagcactcatatttcatgggaggcaagtttgaaaatttttattttagtgcagatgtgtacagcagcattttccaatgagtttgacatggttatgctctgttcgaattatgtttgtttatttcacaaattacaggtgcagcagtataaatactagagctttatgccgctagctcagaattaatttttacaaattggaaaatgttaatacattgatttttaaaagttgaatttaacaagcatttatgagctctaattttgtgtattagaagaatcattaataaaataaccagtacttattgagcactaatatgtgcagtttaatgctttattaatgatttttttaacagtcaaggaaactgaaattaacaaaatataagtaacttgcatgaatttcagaagttttcaggtaatagaagcaagattcaaattcactttttactcagatctcacagtcttaacattattctactctactgctctagaaacacttgttttctcctgacccttttatcccattcttcacaaactgtcattctcaaatttcaatcttcatccaaaacccgtagaagggtttgttatataaaacacaggatattagactccagtcccaacagtttctgctagtagtttaggtgcatacctataatatatatttccaaaaaaaaaaacctaggtgatatcaatgcttcttatccggggaccatgctttcaagaccactgcctacagtttcccttatgtttattgataaaacgggtggtatccattgtttgagttctattactattctatacacctgttctagttaaacaagatttagacacctgtgagtccagatgtcactgatttgaagatgatattaaatattctagtaccttcttcaaatgcttgttaattacctatcacataaaagtcctaattgattaatttattactcattaactggcagagctgtttcagtcagtctagactagacatagtttgcgagtttagaaatgtattctggagaattgattgatatgttatctgattataaaaatagaaataaaagaagaggtctggctgccgagccatgtacatatctagtattccactgaagatgcatggaatataattgtatattcattataattgaattattgtatctattttttcattgttaatggtatattgtttctttattacttcacctataggctattggataaaaaatgtttactattgccctttttattttatactttgaggtaaagccatttctacaaataaacaatttcttgtagtgtcttaacatccccacgtggaatgttttttaaaaatcatgtagcttattctaaatctattctaggcaaatgttaaaatcattttagttagaaatagaatgggatcaggcttcagtagatgccattagaagtggtggtttgtactaggaaggattcttcacttctacatctgtttaataagtttcacactttaaaactcattttattatcacaactgaagaaagagatagtaaaaatgtggagggatctaataaaatctagccatataatatttggagagggagatgggaaagggaaggagagacaggtaagacgtaccattaaaacagacaagcacacgataattcatggatgctgattacctgaccttttcttgcagcagactactcctgtgagacaaaaaggctagtaagaatacctagaatgtactttagatattatttttgagcactaatatagttagcctcaatgataattgcttttaagcaggccacacatacgctacacacacagacaaacaaaacacacattcatccacagggatgactgccatgtgcaaacatacactgaaaaccttctccaaggcaatgtccttcaacatcttttaaaaatgcattttaattgccattgtaactggaaaccgtttgcactcaaaattaaaataatcttcttttgctattcaggatatcgattatgttatgtcctatcacttggatttaattagatgtattttttttccatgccgaaggaggtaaaaccttagatataaatactgaaaaacaagcaccaatatttcactcatccagaaagaagtggctttccacattattcgcttgtgtacaattcttttttcagtttttctatcttacattaaactcatttactcataacatatccaagctgaatgctgcttttggctagaggtaatggtgtaagcactttttcctgccttgttaatcccagccttccacatacaagaaactttatttgaaatctgatctcacactgaatattcttattcttatctcaggtgtcaacattatcccatgtcccatctcagagcatcacatcttacgtgatcatattgtgataaatcatagcgttctacagtatgttctttgtttttcttatagcattttattgttgtactgtatttgttaaaaactgtatcataatacgtaatgtctgacatcaagagatcatatctttcctgaactgtttgcttctatattctgtaccttatgtctctttctgtttccatcaatacctttcaggcataaggaaaagaaggacactgattttcaattaatagtctctggcccaaaccctctattaggtacaaatatattaaatagatcatttttctcaacctatgtcagtgtttcataaggcaggaattatttttactttgtatatggaaaaaaggaaaccctgagatgctaagtaaattctttggtttgttaaattgaatgtaaaacatatttctgggcatacgtattgggggattggatagtccttgttttttctgagtgcattggttgaggagaatcctttgccaatatagtaatgcacagaggctctgcctatgcaaccttgaagaccctccacatacatgcacacacacaccactcacacacacaccacacagacacacatacacatacacacacacaaacacaaacacacatcacacatatacacacaccacacacacacaccacacagacacacatacacatacacacacacaaacacaaacacacatcacacatatacacacaccacacacacgcacacatagacacacacacacacagacacacacacacacaccacacacatggcacacacagacacaaacaccacacacagacacacggccagccgaagtttggagaaggaggcagcatggagaaaaggggagtctgacaccagcgagtttgtgaggaaggggaaggccaaggacttctaggggcaccgggctctgacataaatgtctgttgggggtgaataaagtcctgctgtgtaaaataggctcctcttgaatgccctccatatgaagtcatcctatgaagtctaaaaagaaaatcacaaattgctaagaaagatgaagtttcttaggaaaaacaatgtcaaaatgagcaccttgtactgcctggcatgcagtcaggacgaagcagtgggacgcagtctcttaagtgtggggccgtagtggaagccacggccagttggcatggaaatcacttcattctctgagccacacagaaagtatccccaggtcttcaattgtgttttgacagctacggagcagctgtctactccggcaaatgcgtctaatgtgctgtgaagattccttaattctgataattcactgctcttataaaaaagtcatgtaaaataaaatatcatttagggagagaatgtagcttctcatgaactctggtgaggacccatttcctggcctagaagttcacctgtgatctatgtcccctgcccacctgggctgttgggacttctgtgggtccactgcttacccagtgttttagacagatttcctccaaattgctccattttctctaacagccctagcattattgtgattaatttgactgcaattgagttttattacgagactgaaatttgtctttgactttggcagggaacttgcctctttgtcatcatcatttctagccagccagccggagctgtggtgccagacagtgcaagcgacaatcagcctacccagattgaaggtgtgtgtgtgtagggcctgcagagagggacagtgatgaggcagggagacgggggggaatttatgcggggagttggtccaatagtcattagaaaatagtcacaggaggacaatccaaagttgaatgaagtaagagcatcacttggtgactgacagttttaattaattcattaggaaagagtgtacctaaattatcttgtaccatacctgtctcacactgtctatcctgagtcaaaccaattaaacatttaaacataaaatagggtgatatttcattaagcataataacgtgcatttctcagctcaaaaatatgtcatatcaccaaacgttgcagaaaaatgagcaaatgaaataaatatggaatccacaatagaagaaaaattataaaaaatatataaaaacttccaattccaaactttacagaaattgttaaataaactatatttatattatgaaatgttaattattcattaaacccccattttctgaaaattatggtgtcataattatataatgatagtatgatattgagtatgaaaagtatgatattaaatgatataatgcaaattttgcaccctttttatggacgtgtttaaagtttgtagcagtgcaaaattttaacatatttctttctgaatggaggtaataggagtgatttttttttttatttaattttattttgctgtgatttctaccaggataaaggtgtaatcatgtatacttagaaaaaaaaatttaaattcttctgcaaatccaagaataagtggaggtttggcattaccattagagatttttatttttatctatcatgttgggccaaagtattactgccatttttttccatttatattttagtatagttccaatatttagaaactcctttaatgtaagttagagaaaattggacatataatatttaggaaaaagaaaatgcagtgtaaaaaataaagaataaaaaagttttctctagaaagcttgaaatctggcaccattatgtgaatatggggcaggggagcctttaataccagtgtgagctggagagcaggaggggtgagcacaaggcttgataaagaactaagactctaacccatacattctgcagcaagatttcttctgatctttatgttcctggggaccatggaaactagccaagggattggtatttctgcatgctaaagtgtagcctcatgcaaacctttaaaaagaaaaatacctgaggaaaaatgtgaaatttctcaatttcagatattcaagggcttcctgattggtctccctgagatcactcaccttttcttggatgatcaatattacaggataaattgtgtttcctaaaaatgtttacattgaagtcctaatctccagtgcatcataatgtgactttagttggagacatatgtttaaagcggtaataaggttaaggtgaggttatgagggtgagccctaatctaatatgactggtgtcctttaagaagtggagatgaggacacagacagacatagaggaaggatcgtgtgaagacacagggggaagacaaacatccacaagccaaggagaaaggccttagcagaaaccaatactgctgaccttagacttctagcctccaggaatgcaagtaaataaatttgtgctgcttaagccaaccaatcttggcagtttgttatggcatccctagcaaactaatgatgcaggagtttttcttaaccccttcatcggacttgtgacacggatgccccatttacttggcctgtcatgctcaacctcttgtacaaagaatgcactttgggcaccagcaagagcaggcttcatgtggaccctgaggcgatggtgcctaggtgggggtgcctgcggcccccaaagccccagagggcatattacaatgctctcttagctccaccgtctgtggacattgttatgttatcagctcagtgggcctcttgccttgtcgcgtggggctgctgctgtccaccagtgagggcaaaggactagtgtgacagccttttttgggtacctacacttggtgggtcctgagctcttgtccagcgtccaagaagaatgaggttgcacggacacttgaaggataatggaggtagataattttattcagcgaaggaaatggctctcggcagagaggggagctggagaggggatggggcaggcagataatcttccctgaagtctggccctctccggctggctcttccccaaagttaagccatctctcctctgaagcccagccatccctctgaagtcaagtcacttctctccagtcaagctgcttctctctctctaccaaatgagtctgggtctttatagggcacaggatgtggggcagaacaggctgtagatagttttggaaaaggcaacattctattggtaaaaagacgttattcaaaaagaaagaatcaggagagaatgggcaaacagggatagaagttctcactttgggccacaggtttcaggcttttgacttgatggtggggtttcaccagggactcacccacccctgtctgcccagaatttctgtttcctgcctctatcattaacacaaccaccaagccatcctattcacctctgccttataaaaatatgaaatactagctcttttcctgttctaaaagtgcttttgactggtctctgtggtctacagattaataataatctctatatgcttattagaattggcattatcaaggatattacatatatatccttatttagtatttataatatcttagtgagatagagattttaaatttcattttagagtaactgagcttaattaattgcccagtgtcactatgaacaagtctcccagtgttgagatgacactttcattttagtttttattattcaatgtgtaaattaaaagagttggagtcttgaaggtttgcggaacttgaagtattgtcttttcaaggttttcctattgtgctagttaaaatacttattgaccaggatgaagtcagacctgctgaagtttacatcaaggatggtggagagaaattaatttgtgggcctgtctcatcttctcctcaacaaaacccagtatgggggtcttggagacaaacagacctggggaaaattcctgctgtaacaactgaccaactctgccatctggcacaatttctcttagctgcagttttgaccctttaaactgagaataataactagtttatggaggtgtgatgaataaatgattggctgcatgcaaaacagcagagtgaagtagaataagcagtgcgtgttggctgttagtatcatctgatatcatgtggggatgatcaaaagacagagagcccactaaaaagtactttctcaatgtctataaaaggtaattgatttaacttgaaatagtttagactggggggagatagtaaaaatatcatttcatcttcctcatagacctgagctgaagctacccttactaacctgcttttgtgacggaatcaaagcttacttaattcccaaggtcaggcagctactaactggtacagtaaggtagccaactctggcaaccgagttctacattttcacagctacttcagtcaaatcctgattcaaggctgttaactttcacacttctcaagtgtctgtcttgtttcctcagaaccaagccagtggtagataacgtagaaaccatgtaataaccgtaattggcaaggcttcacttttcctacctcaagttacatgtcaccacaggatatgcaaggaaaaagagaattttccagttccttttcccatctgggtcagggaatggccaaaaaatgatcacagctgagaaatttatgtccatgtttaacatccttgcagagcctactttgcaaggaggtaagactacctgttgtcactggtattttcttttactaaaatataatttcacatttagaagctaataaggacctgaaaagttagctatgctatttatcataaaggtaatactatttttttgcagtgatggtgcttcctttcctgattttgaagtagattgtctctaagaagagaaatgatattcccctgaaaatcatatggccttcaggaggtgggggtgggaggtcatgaggttctttggatttgtgggaaagacgcaaagataatatatcaaagaagttaatgaaaatcatttacccagatgtgtttatcaaagatatagtgtttattcattacctctaccacacaccccatttcaaatcatttcttaaacctaaaaacagaaattatacacgcacagacggcctctaacttatgacggtttgacttaccatttgttgactttaagatggtgtgaaagcaatacacattcagtggaaaccatacttagaatttttaattttgatgttgtcccaggctgtcagtaagcagcaggatactctcatgatgctggcctgaagcagtgagccacagctcccagccagccaggcaatctcaagggtaaacaactgacactacactctacagtgtgttgccagtgtgtttgtgttatgtatttctgcaacccatcatgtctataaaacatccatctgtggcagtactcaacacattattataaaacaagcttcgcattagatgatttcgcccaactataggcaagtggaagtgttctgagcatgtttgaagtagactagcctaaactgtgatgagccataggttaagtgtattaaatgcattttcagtgtgtgctattttcaattttggatgggtttttttttttcaggacataaccccattgtaagttaaggagcatttgtattatttttctagcccatcatctctgccagatattttttaatctttgagattcccaattttatttgactatttcacccagggtaccactaatcacaatggcaatgccaactgaattcaggcattctattgtttctctttgctctcttttagcaattaaagaaggatataaaacttgatactttgggacacttcgttttaaacttcgggagtaggacttaaggattctgaagctgaggtggtaacagctatatatcctgccagaattggtctctgagccccagcctgcttctccatcaagtcataaaagtgtgcgttctgtgtactattgcctttaagggtctgtctgaactacttctcccagaactacttagttcatttatctcttctccagtgtggactctgaatcagatttgctctctgccttgttcccaggattttcagatttttacttgcttctcatttattcatccatcccacactttggcattttctatgtgccaggcattatgatggacttcagggatagttacatggctcaacaagatagacatggacccagtcttcctagagttttcagccaaattgtagtacctgtgagacagaaaagcctagcacctcttgcaaggcaggaagcaaagtagaggagacagaaatgtgcaatgtaaagccttttccttccaaaataaggagtggaatttgaaaataattatgacatttatttttaaatatatagtccctacccagtgttctgggatatatctttgacatgggcaaaaacaaaaacctcagcttcagccaaaacaactcattctatgcccctagtctagattattgcattttcttaccccaaatttacatacaattcttcttccagagacatgtatgatagggaagggaccccagaatgcttcctgttgccagatcaacactttcaaactcctccttgccctcctctgaattcttctagcgtaactgccatagaaagcatgctaaatattattgctttgagacagaaaaacttggcatttaattttaacttcaccactctacttaatacctctgggtttaattttgccatatgaaaggccaatctagataagtggcacacgtttactgcattattgtaaaatttaaatgagataatattcataaaagccctccagcagttaatatgtgtattatttctttgcttagtatgacttgaaaatagtgaaatctgtacattttattaaaaacaacaagaaaaaattccctgctttcataacttgccagttttattgacttgctgtgtaactcatggttgaaacaatgcagatttatatttaaggtagaaattctcttttgctcatttcaacctaattacaccaaattttgccttccttcctttttcccccaccttaaccattctcctttttcccttgtggcaaaatctaatgattcctatctttaatcatgagcaattaagtcacagtggaatatctctttgcctctggaatgcatggtaacctcatactctgacttatgaaactggaaacgtaaattacagcataaaatatttatcaattaaaattgtgttaatttttttaaatccaggtaatttttaacaacttttattccaggaaattataagtctatatttgctatggtttctaccattaaatatatgtatacacatatgcatacatatatatatatactatatacatatataatatttaatataagtttaattttacaatgaacccaatgtaccaggttggtgctttttaatgagaaatatatgtaatagaatgtttaataaatccatgaaatattaaacctaacttagtacttgggaatcttaaatccctcattaattttaagaaaggatgataaatataaatatatatatatattttatatatatatatatataaaatgtgcttttagtgatgcattatttgagccttaatacatttaaaagaatggctagaccagtgagcctaaaggacgttaaagatctttcctattctggatagaacagaagtgaagctgatgcatttttcagtgtctgttatctaccagatactgtgctagtggcttcataatcttggtctcctctaatcttccagcaaccccattttaaaatgccaaaatagccacttaaggataaggacagcagcatctctcaaggctaacttcctctctcatacctagtaagtggaaaaacagaggcttgtatgatatttaaacatagcctatgcacttttctatttcctacactgcttttagttagaaaagaaaaaaaaatgatcacaaatcactggtaaacatctgcaacatagaataatgcttctattatccagaatttaattaaatacacagatactttttttagtaccaagttggtttatgttagagtgtaactaatatgctcttcatagaaatgcagaaagacaagtggttaaaactatttgtgtaaaacatgatattatagccttggaagtgagaatcaggtatgaagcaatccttcttaatgtagggcccagctttgcttggccactttagagatggagtgtttcagtccttgtccttgttttccatctgtctggtctttggaaagcagaacagatgtaaatggtagagttctgagccattcaattagatttcatgcaccactgacccaaacatttctcctcaatcttatctgagttggtggcagatgtgcagcatgtcagaaagcattttcaaattaaagatggaaacatattgtatgttggttgatatggtcacaatatgtgtaagtggtaaaatatgtcaccactagagcaacaactatgatgcaagaaggaacaggaaaaatgggcatttcacatttcctttccttattatcagaagacaagaaagtataatttgtcaaatgtgcattggaaatcatgggcttcctgatatgtaataaagaccaatgtaaggctaattggattggactctgcattctgccatttacagggcttaatcaaggcatcttggtaatagagctgagtctgtgatgatttatgtagatagggctttgccatcactgaagatgatgagacttacactcagggaccctcatcattacccattcactcagcctcacaatccatggctgactcaaatcatgttgtgaatcagctaattaacaatgagatccttgcacttttatagatgatcaattaatacttgtcaatttattaagtttgcttgatgggctttagcaggtttcttgttgaggttatgagaacaatgatggcatagaagagagaaagaagcaaatatatatgtagataacctaccggctgtatggaccctgggcttaatggagatctcagtacaccctggggaaaggtgaggcccaataaaggcttccatactgaccatgaagagtgttttgaacctgatccaggatctgaagttctgaaatcacccacatattgtgtcattatcaatgagagtatacaaagaacagtcaaaaggaaataaacccatgcacaggtgttacctaaaggatttcttctcttgggggtaagtgtgaattcacttgagtagagagcattacctttaaaaattatagattaaaagaattacaagggatattacaactaattttttcttctttccattgagtgtttgggacccatttccacaccctgcaacatacacacagaataacttttaggtccatttattcccaaaatattgaatttgatgtcctctaattcctgactcatgacagtcaagagcagaggcccgtacaaaccaatttcttggtacctctcttcttcctggttctgccaatactgagtttcctctatcagactcacagttgacctgttaacataggtcatgctagtttcctgtaatattttcctcctgctcaaatctggtactttccacacatttatttttctattatcagctaccttgagaaagacaggagatcatatatttagctatttagctatttttttttttaccatattgatgttcattgtagtttaaataactctacagtggttgcattttaataaggctgctcctgacaacagtcctgaccgattttggaaagataccaaaaataaaaataaggatctccagaagtcctgtggactctgtcgttggagctggagtgtgcctccatccgtagacttcctgccatggtttccttccagcacattttcttcagggcatggaggctgaaaatgcctgacttctccatttaaatcactttaagcaaaacacagattatttaagcatatcttttgcatcctccatgcccagtagtaattttgcaaaattactgggaatctatttcagggcaaacttggcatttaaattaggtggttttaattagcatcttgactgcatgcagtcaacagcatgaagagaaggacagggaaaaatcacatcagcttatatttttgctgtagaaaaaaataaataaaacaataatatgctgaaaaaataacctcaaataattcaaagcaagatggctggcaattttctggaattagaatgataaactttatcatatattgaaattgttatatactgcaagactccttttaattatctttaccagaattttcataaagtttacctttcttctacacaaagaggcccacagacagtgccattgcagttattctaacacaggtgccaaatggactctcacatacatcccttccccctccactgttaaatattacccatcattcaagccatgacttaaaaactcacttctaggttatataaaggtaaccttagccacaaatgtcatctctctgtagcttgagaactcccacaatattctcatacagtcatatggcaaaacaagaacaccaacaccattcattgtttaccagttctaggcagtacaatctcagtgcttttccggaattgcctcatttaaccttcacagcagccagatgaggtgtgtgctactatagtgtcccattttacaggtaaggaaacaaagacgctttacaaagtgtaagtgtcttgcccaaggtcacagctagtaaatgggagaattgggtttgaactcacagtctttgcaccacacactacattatattgtgaggtggagagagtctctcaatatcatggaatatgttttacatattttcatgtgatttgaattttaaagatagtgattggaagtgaactatgaataatttcattttatatatattttagttatcaaaacattgccgttaggctttttctgcagtaaatgattacattacaaagctgttcaggagacgttatttttttaatcattctctagcatatttttccttttgtccttttatactggtaagaacatccagattctcagatgggcttagctgcagccgtggagtataaacaggatggaaaaatagggtgttaaccattatttgagttggctctcaccatcccatggaactagaagcaatttagaaacaggtggccacagagtttgctcaagaaagtcctgccaaaccaagatagggactttactgacttcttcttactctgctgatgccactgtacagagctcagatgaaccttggttgttgactttactgcaagaaaaaaaaaagcggttccacatacacactctttcaacagcttgttgaattccaggcacactctgggaagcccttagaagtgatgacctcatgcagagaggaggctggaagctctgtcatttcaggaacagttacggaagtaggagtgcaattgaaactttggggactttatttaccactgtattcaatgacttcaacagcttcaatatggaaggaggatttaatttcttttgtgcaggataaacaagagaaagatctggctcaatattaagaagaatataaaatggtcacagagtgtattggaaaaagcacagaaatttattcagaacacttgattctgaactgagaccctggtcttgctgctgtcttcccataaggtttttctgcttagactttctgaaattcatttattcaaatgttaagtgagcatagtaatatctatcttttagatttggggaggataaaactactgaaagataaatcagttagcatgcatactaacattagggaggagcattcaagggatcagtacaggctgtgcaaccttttcccagtattgtcaaatgggaattcaaaaatccaataaacctgtaaaattgcttccaaaacagggactatgaaaaatgaaaatgtctaccattctccctgaagtccattaagggattcaaatacctataatgacttaaataagtttctttagtccggatttaggaaattgaaggttgaagtacaaaaaaagaaaaagaaaataagtaatgtatgcattttagtattatcttctggaaacaatttcttaacctgtgtgaattgcacaatccttgaacatgtggataccattctggtcggtaagcaagatgcagagtgctgtaggtgtgtacattcttaaatgaaacatacaccagtgagaagaatatacaggagagacagaagtatttctatccatggtagaactttctaagcaagttacccccaaatgagcatcctcctgaagtagtgagtttcctgccatggatgtatatgcttgagttaaaaattccttgagcaacccctgggtagggaggttacacagagctttcacatacagatgagagaattgaagtaaacatggattttgaagttcctttctaccatgattccattatacttcaggactttaaaatggggactagttgggatagatctgtgaagttaaaactgaaggaaccttcagatagtcttgacaataaggacagaagtcagaataaaatgatttcctcaagaatacctttgcctcctaaagtcagccttttttctcctctttgtgtatgaagagaaagggagtgaaaagcagatgtcccaatgaagatgtgattttgtatcattctggggaactgacaccaaagggaatccagggacccatggaccaggagccaggattcaccttcttccccagcaataaaaggggtgggagctgccagcaactaaatcgcagtttccagccagggagtatggtggcaaccatgctgcctaatacaaacaatgggtttgttccagtgcacacctcaagaaatgtatttaaattccaaatcccaaatgaattcggaataagaagaaaatgggaggcgccaaagagtaaaaagtcagagaaaagtaaataaagaggtaattttagagaagaacagcaatatgaaaatcttttcaagatagggttgtgtaaccaagcatttgtggacagggtgaggcaagatatatatggttttctttttttttttttttttcagataaaaatagcagtaactaattaagaaatcctggatcataaggaaaagtagaaagaagataagtcagttctagtcctagcacctaaacagagctactgtttatctttagataattcctttccaccagttattttcagtgtaagaattttaagttggcccggacgtggtggtgggcatctgtaatcccagctacttgggaggctgaggcaggagagtcacttgaacctgggaggcgaaggttgcagtgagctgagatcacgccactgcattccagcctggttgacaagagtgaaactctgtcaaaaaaaaaaaattaagttgaaatagttttaatggccaattttatatttaattttcatatgaatctagactatttctcttggttattataaacccttcaaaaatacaatttaatggctatgtaatattccttaaatagatacacattaacttattctatcttctgattgttggacaacaaggtttgctttcattgtttttactattcaaaagaggttttaattacatttttgttcacaaagactttttttctttaaattatactgctagcctgggattattgagtgtgaatataattaaagttttaatatacaatgttgcaataagttttccaagtgtcttcagatgagcaaaaacagtgtatgccttttatcacttctctgaggcagggttttggttgttactgtaaccttcttttcaggatgaggtctgggaattagtcattactctgtctgctgagaaaaagaacctatagcactttacagaaagctgctaattaatccttccaactctctagtgtgggaaggaggtagaaatgtctccactgcagtatttactaagaaatattgtaaatggatatgacagacaccaattcaaattccccggatgagggagagccgtcttgctagatgatcatgacttctgctaaaaacaacccccattgactccagaggtttcctagaagattctgggctgctgcatttgccatgcccatcgtctctatattttgaactcatgagaacccttgggtctagttcgggattccaccctcttccgaagagatacatacagtctgaaagtaatgataaaatttactaagtctttcaggcaatgtttaaaatttgtgcctacagtttccttcagcttttgtttccatttgactgtgggcatccccagatgccttcagccgtggttttttttttttttttcagtctttgtaatagctaacgctgacctccacgttggcactgaatttccttttttgatctcatgttctcataaggcaagatagccccatgcagcctctgatagggttcacgtgtctttgttagttttgtttttgtgatttttgtttgcttgcttttttatttgcaagtaattccacactgaaaatttaaaaataaaatttaaaaataacacccatggccaggtgtggtggctcacacctgtcatcccagcactttaagaggccgaggcaggcagatcacctgaggtcaggagttcaagaccagcccggccaacatggtgaaattccgtctctaccaaaaatacaaaaattagctgagtgtggtgccaggtgcctgtaatctcagctacttgggaggctgaggcagaagaatcacttgaacccgggagacagaggttgcactgggccgagatcacgccattgcacctccaacctgggcaacaagagcaaaaccctgtctcaaaaattaaaaaataaaaatgtaaaaaataacacccacatatccttttcccagactcagctattgataacattctaacccatttacttcatcattttccatctaccaagcgactgttcaatagctaacatttttttctgatccataaatggcctttgggcatatcgtatactctgggctactatttcatagacttgaagatatattctgcctgcatttagttacataagacatccaaatgctttctcccaggcccctgatattacttaaaggagtcagattttatagctctatgagctcccctttacctggagtgcttctttttatttctagccctttttttaattacactttcagctactgcaaatacttactcatgtttcaaggatcagctcaaatattcaattttagggactttctatgaacttttccctggcagaaatttcctttattacaactcattatcgtatttcattttctcctgtgtgtttttttctggtagttggtaatcttcgcaaaagagaaggactgtgtagtattatataattttccttggtatctagcaattagtttagtaaatgccatgttttaggtaccccaaaatacttgtgaatcatagtaatataaatcgtctgtctttgttcatttacgttattattaattattttgtttaatcttttagtttgcttttcctcttgatgattgacttggttcatttaataccccattaactcagctcttactctaagcaagctgctgtgatagttgctcaagtgggaagttacaacagttaagaatgcttttggctgcaacacaagaaaatctatagttaaggtatctggatataggtgatttagtctttgatgcagtggctcattgatatcatcaagttctcaggcttgtttgaccttttcactctgccattgacaggtttgttaactcatggtcacaggatagctactgtacctccaagcatcacattttcatctgactgtgtttaagcaagaaatgaagaggtctgggtaaatggagatttctttaaattggatgaaaattgttttccagaaatcgtccagaagacttttccttatagtgcatttgctagaactgggtcacatatatatgcttagtggcaagaggtgttgggaaagtaagtacctggcataggaaaatagaatttccaagactgttttaaaataatcattaatcatatctggattgggtccatcatcatcataaacaaagccaggtttctctgagcaaagaaggggagactaagttcttggatagaaatgtcaagttgtacgacacagtcacaaatcaatagatcatttcagaactcaatccaaaactcatatgttccaatagagttgggagggtgaaaaagcggacaagtgtaacgccattaatcatgatctggagggtgagaagagaggagacagatgccccagatagatataattagtattagtgcagtccaccaagggcttaaagtgtggcccaggagtcaagatgtccaagcatcaggagtgtgtcagcaggctgatgtttacaaaggttaggactttctaccagcttatttaaagtctgttccagcgagctctgtttccacgagacgttactagaaaaatggaggctgtagccaagtttgggagatgggctatttgacattaatgtaccaaaatgtacacattttaagcagaggttgtagtggtcagtgtttctgaagcttatttgaccatcaatttttttgtccacagaaaagccaaatacatttggtaagtgttgtgtgtccttaacagcgaaaagagaactggcaagaaaaaggtgaaaggccaatcagagaaaaagaacctgaattttcaggcagatttttaagaaagatattaaaacattgataaccaaagttcagtgatcagaacttgggcatatagagattatggttcataaaggacaacgggcccatgagatattagcagcatgggcctttgttgttggatcatctgaacactggactagaagaagtgttcaggtgaatcctctaaattgtagaagcaattttccaagaatgagccatgttcaaggtaaaagtggagttatttttttgaggggagggagcagtgcaatgcacagggtgtccagtcatgactggaagatcaattaaaagcagaatcatggagagtagaaaagggtgaagaagacacaaggcaaggcttgataatgtacatgtacacatgtgtttatgtatacagtacacagaagtatgtatgtatgcttgtattacacacacagaaagaaatcactagagtcccatattcattatttatgttgtgatcttcagaagtttagaggtaattaaaaatagcatgtctagtttcacaataatttgggagatgcacattttttaaaaactcaaattaaataagtttgttcaatatttttagagatctcatgaaatagacccagaagagagccaatgctttcctctctaatatgtaaacatatcttatttagagaaatatagttagaaagtctggcagaaatcagtccaatggtttttcctgaaagcaaagtcaactattgatacctagaaagttctttggggaaagtgtaaggaaccagtaagtgattaaagtacatatttgacacatgttattcaccacatcattaattactcacttttcctccatatgcaggtcagatgatggttggatagagtgttggattttataatgttacattgttataaattgtaggggtagaagacaagagaagccatcaggtgcacctttctataaatgtgggttgggatgaggaaaaaggaagacagttgtgaccaggttcattgggccttgagagagtgatggtatatgggttagcttgaactaatctagaaccttcttcttaacaattaacagaactagaaagaatacttatatcttttggatttataaaggcgatcataaaataacttaaaaatacttgaagaaaagacctgaacccaaatggcttcatatcaaactacaagcaattcttggttaggagaggctaatacagtgcatcaaacctaaaccactctgcagtcttttactaccaccttcgtttgatcttctttcatcttctttgtcccatgatttctattctatctcattctgcaggcatcagaacccacgtagttatttgaaaggttctctccccataatctaaagactccagcttgactaaagttctaaagctccaaagaccccaaattcaagagcttttatgcttctttagcttcttttcttatttttggattctgtaagaatacatgcccatgatggagttgctgggcaggctttccagtccccaagaagggacatattcctgtcttctgagggtgctgtaggtcttctgttgggctgggggaggattcatggtcttacttttggaggggaaaacgccccttcttatctgagctccattttttctcatagacaaaagggtttactgtcattattattattattgttatctgtcctcgacgtagcagaagctaaatacattttttggtttgaaacaacaggctagacatccatagtattacttgtagtgcaccaacataaacaataccaaactagaatgttctcttctcctttcccttttcttctcaaataatgcagtcctgaagacataatatgagacattgcaaaggctgtgttcaggatgattgttggtgctgggcagggaggctgcagtggactaggcttgggctttggagcccaagtgagaggaaaaagtaaaacgtttatgaagtaggaaggagattgcctggtgagtggtgtcagagttgaagtgggtatgggggtgtccatatgtagagtggcttcgtgcgtagtgtcaaagtccaagggaatcttcatggggaaaggagtagtagcaacaatggaagattggttatatgtagtaatattaatccataagtaaatatattaaaggcagtgagagccatgcttctctttggaggggaagaaaaattgcaaataagagaaagaaaactaggatgaacctttttgtatgagactggaattatagccattaatctgaactcatggttttcaatatgtgtgtctatctacatatgtgtgtgtgtgtgtgtctgtgtgtgtgtgtgtgtgtaaatatgtgtacaggcatgcggtgtgtgtgcattccttagttctgtcaggtgagagagcctgggattaatgacactccacatcttggcatctaaataccattcttctccaaaagaaaccagtttgtcctggagaaacattagtttgcaagaaaagtacaagacaagccaagcctggaatgtctttttgtaccagaaagcaaaggagttctcaaaaagaatgatgagatgttcacatataagtgagaccatataatatttttctttctgtatctggtttatttcacttagcataatgtactccagggttatccatgttgcagcaaatggcaggatttcctactatttaaaggctgaataatattcagtttctttatctatttgtcctccatggacactcaggttatttccatatcttggctattctaaataatgttgcaatgaacatgggcatggagatatctttatgaggtggtgattttattttctttgagtatatacccagaagaggaattgctgggtcatatggtaactctgtttttaatctcttgtgggctgtgtgtgtgtgtgtgtgtgagagagagagtgtgtgtgagagagtgtgtgtgtgtttgagatagagaataaaatagtggctaccagaggcaggattaagggtaggaaatggggagatgtaggtcaaaagatactaagtagcagatatgtaggatgaacaaatttaaagatacaaagtacaacatgaagactatagttaattatagtgtattgtattcaggatttttgctaaatgactagattgtaactgctcctgccacagaggaaaaatagataactatgtgagacgatttgtttcatgatagtaactgttatactgtatatgtgtagctgaaaacagcatatattatgccttaagtatacacaataaaatttatttttttaaatgatgagaatatattaaaaggacacataagcctttttaaacggctcctactggccaaatttgggatgaattgagaattataataaataatgttagtaattgattatagctgattaaatgacatagaaaaaagaatttgttctgatataaataaaccaatgaataagataaatatttgttgaggaacaggatatttacatggtctcaccttgtcacaaaatacttattaattacaacaggaaacagtgaatctacattgaagaggccagtcataccccatttgaatccagtaatcagtatgaacatcattaatgatgagtcaagtcccataggatataatcagaagaatgagacatcacatcaataatgtgtaacctgtatctaattatgagggaacatcaggaaaaccaaaattgatagattgtccacaaaacaactgtcttgtagtcttcaaaaaatgtcaaagtcatgaaagtcaaggaaagactgaagaaatgtctcaaactgaagaaaataaatacaatatgacagctaagtacaatgcttacttgtgatccagagctttttgtcacaaaggccattattggaacaactggtgaaatttgaatagaatctgaaaattagatgatagccctgtggtaaagttaatttcccagagcattcgatgatagcaatgcggtaaagttaatttcccaattttgatatttatatcacagtcatgtataaaaaaatgtcctcatttgtgagaaatacacactagagtacttaagagtagtggagaatcaatttggcaatttacactaaaaaatttgcaggaaaaaacattcctttcactatattggaaactttcctgtaagtttagagttagtgacttcttgacaaacacctgaaatctgagctttaaaactgtaaaatgaaactataagaaaagaggaaaaaagatacgatgctgaattaaacatatgtatcacatacaagtgccactcttggatgaaatgctcttggtacagagcctgctggtaggttaataggaggaacataccgatttccatgccatgttcaaaggtgaatttgatcattctatgcaaattatatctgtactggagacttgtaattagtctaagcataatatgattaggtggatgaaatattttggagtttggttttgttttaaatgtaaatactcatgaaaagtaaaacatactgcactgtgtccctgggaatatttttgttatctttaaaatactcagtattataggcatttattaacacagccttacatttgcccggtttgacctggaggccgaaatgaattgtgacttatgtcccagctggtgttcccaaattatggcaaggactggatgtcatttgttgctgtgaatgacttcttgccagaaacctgagatctaagcatccaaaatcacactccaagggattcctgaaatacactttttttttttttcttttgagacggagtcttgctctgtcaccaggctggagtgcagtggtgcgatctcagctaactgcagcttccacctcgcaggttcaagtgattctcctgccttagcctcccaagtagctgggactacaggcacgtgccaccatgcccagctaatttgtgtatttttagtagcgacagggtttcaccatgttggccaggatggtctcaatctcttgacctcgggatcctcccgcctcagcctcccaaagtgctgggattacaagtgtgagccactgtgcccggccacatatttttttttaatcttctatcatataatcattaggtcgttgagcctttcaaaatcttctgtttgaaaacatccccttcaactctgtcgttgccatgtgaaaagatcaaattgaataatctactacccagtgtctctttatgtatgaaggctttaagccaaacacaggataccattgtcttaatcttcctgctgtataacaaaattacttaaactgggtaattaataaacaatagaagttttttgctcacagttgtggaggttggaaagttcaagtgtctagtgagatctctgtgctgcatagatggtgacttcttgctgtgtccacacatagtggaaagggtaaacaggctcccttgggcctcttttataaggctactaatcatatttatgaaagcagagctttcatgacctaatcacttcccaaggctccaccttttaataccaccacctggggatttaggtttgaacatatgaattttggagagacacagacattcagaccatagcagctatttacccatgcaaataacaaatccagtgatcaagaagctagtcatcaccacagttggtcagttgcaaccactgaataaagacaatgggatatttagctggaaagatgttcagatgacatttcttttctaattttcattgaaatttttcaaagctgctagaagttagacttttttaaaaacactcccattaaaaaccagagaagctatgctcttgtttatattggaatcaaaccaaatttaacccccttttaagattttcttggctgtaagaatttcttggtaatggctgaaagagccctgattatttttttaatttgacttttatttaagttcaggggtacatatgaaggtttgttatataggtaaacttgtgtcatggggtttgttttacagattatttcatcacccaggtattaagcctatacccattaattgttttcccgatcctctccctcctcccaccctccaccctccaataggccccagtgtgtgttgttcccctctatgtgtccatgtgttctcatcatttagctcccacttataagtgacaacatgcagtatttagttttctgttcccgtgttagtttgctagggataatggcctccagttccatccgtgttcctgcagaggacaagattgtattctttttgatggatgcatagcaaataccatttgacacagcaataccattactgggtatatacccaaagaaatgtaaattgttccattataaagatacatgcatgtgtatattcattgcagcactattcacaatagcaaagacatagcatcaacccaaatgtttgatcagtggtagacttgataaataaaatgtggtacatatacaccatggaatactatggagccctggtgattttatccagttgatgatacacttgggattactaaagcatagccatagccagttaggccacttcgtgttattcataaggaataagtcaaactttggactgcctggtaacatttcttcatattaagtcctaccttattctgagtgcaaatccatcatcaggtagtacctgttttctccatggactggacagggtgcatttataagcccatctttgtgtttagactgtactattaagaggaatatagcaaggacacctcttctccatttcacatgaagatggatgtattaagtattaactaggtgtttgcaaaatactttcaaggaaaaaaatgcaataaaagtgctaaatataattattattaaaaaattatgacaatcatttagatgagtaattttaaagctcttcattaaacatgattggatattatgttaattcattaagctctacttcaagtggtagataaataaggtgcattattaatatgtcataaactaaatgaaataatgcctcataggcctattatttttaaagtgccttgcaaatattaacaaatgcttacattcttttgaggacaacttgtacgatttgataggaattgttgcagtaattttgtttctcataatataaaatgcttactacaaaacctagggtctttaaatttttcagtctgtcgttttttttttttttttttttttttttttttttttttttgagacggagtctcgctctgtcgcccaggctggagtgcagtggcgcaatctcggctcactgcaagctccgcctcccgggttcacgccattctcctgcctcagcagtctgtcgttttttaagtaatgtatacttatttaaaaatacagatacatataaatatgaaaataaaattgttgctaatcactaaactacccaaataaagtctttgtgaatattttagaaacttttttgtcagttttctaagcttatatttgtgatctgtgcgcttgtgtatgtctgtatttctttcacaaagtgtcttattgtatataatgtctcatatattccatttctagttaaaatattaaacagaccacccttcccacactatttatgggcttgcaatgctattttttcactaaaaacaagtaaagaaacaagcaagtaaagaaacaaaaaagcagggtttcttagacaaatggctaatcctaggtctggtgtataagatgagcctgaaacattttcataacagatagtaagaaaagtagggcccatcaagagtactcatgatccaacctggagcccaggcactcacagcatcagaagccaactggctgaatgttggacaattcaggcaataacatcaatggattgaaatacatcaaatatgttaaaaatccatgccttcaaaataatacaaaagtaaaaaaataactgtttaccaatgcaggatgcttgtaaatcaacttatgattaaaacaacaaactaataaatagaaggaaagaagaaggttttatcctgttttaaattgtctttatttgtattaaatgtatgtggtaagtgtaattttgttacatggatagatcatgtagtggcaaagtcaaggcttttagggtattcatcatccaaattaatgtacactaagaaacttcttatcatccatcccctcaacctccccctttccaagtccctattgtttattattccacatgtgagcatgttatttaccgcccactaaatatctatgtccacgtgtgcatattttctagctcccacttgtgagaacatgcggtactttctgtctctgagctgtttcacttaagataatggcctacagttccatccatgttgctgcaaaagacatgattttatctatttgcatggcttcatggtattctattatatacatatgccacattttatctcctctatcaacaagtaaccaaatagtagatggagtttttttttttaatagaagtatattacagctggcaagtgagaaagaactgtcagaattagtataccacaattttccaactctaaattaattaatagaccaagacattgattattaacagctgttaacatcaataaaacagagtacaactaaatagcatatacttcctggtgaaataatgcacaccactcatgaactagtattgtttaaaaaatatgaacctagttctggtcaaacttctagatccaactactaatttatagaaaatcagatgatggagaaatatatgagatgataccatggttgaaactagcaaaaataagattgtagggaactctacaaggagaaaaaaaaaaccctggttcttccaatatacatacatactgaagagaaagagataacaagaaggaaacctacagggtaaaagaaacttaaataaaaatatcaaacaattgtgaaatgtgaatcttatttatattttaatttaaacaaaaagctgctgaaagatatcgtcaacatttgtgaaacatttagatatgtgaacactgaatatttgattattttgaaaaacattgttcacctttaggtgaaataatagtgtgtttatgtgtctatgtgtattatacatacacatatatatatatatttaaaaggatatttgtcttatagaaatagatcctgaaaaatgtgtatggataaagtgatatgaatttcctttaaaataattttagggcggaaggtagccacaagataaccatttattatactcttctgcctacctttacatatttttgaaatttaataataaaatattttaaaatatactgacttttctttcttataacaaagttttctttgaagacatgtgatatggtttggctctgtgtccccatccaaatctcatcttgtagctcccataattcccacatgttgccagagggacccagtgaaagataattgaatcatggtcagggccaggggggtggtttcctgtgctgttattgtgatagtgaataagtctaatgagatctgatggttttaaaaaggagagtttccctgcagaagctctctctctctttgcctgccaccatccatttaagatgtgacttgctcctccctgccttccactatgattgtgaggcctccccagccatatggaactgtaagtccattaaacttctttcttttctaaattgcccaggctcgggtatgtatttatcagcagtgtgaaaactgactgataccacatgattgccaaggtttccctaagcatgattaataatatattattgcttattaaatagatcagagggtctaaaacctacaaactgtgaggccttgaaagaaacttgatctagaatttttgtattccaattttattatatttgtctccaaaatttatctgtttttcttacactgattattaaatagtctaatcttttcccattattgtgaaatgaccctgttgcttcattcaagtacactgtgtatgcttcagttctctggcatgtccctgggctaatcctgggttctacttattcgttatttgtctcactgcttttcagctcctccgtttcttttgaatttctctctctctttctctgtctctgacacacacgcgcacacacacacacacacccacacacacacacacacacgagaatttcccaaatgtttgatccttgactaaccatttttatttaaaagcagtaaaaaagcagattggaaaccctggatataggggttaattgagttatagcagcagtgataagtccttttgctttggctggtctgtttctacagcaataaatcttccaatcttctgccttgtctgccagctttctagaagttaacagaagagcttttcttgagggtggggatataggaacctaatgctccttatataaacttcaagacacctgtgttttcagctcaccccactttcagaggtacctgattccttcaatccctgattctttccagcagtcacatgcaggaatgggatgcttcctgttggttttcctctctatctgcataggtgatgataagtttctaaagtgtttgcttcctaaatgagttgtgactataaagaaactttctagcttccaaaccactggtgatatctatgcttattttcttttattcttgagggcagatgccttttctcttctttttttaactgttaaatgaggttttgagctgttagagataagttccaaaaataactaaaatcataactctcaaaatgttaaagattttatttaacttactaatgaggaaactagtgagacattacaaccagttcaaagaagaatccaaggaacagatgcatttataattagcaatatttaaatgaatgtgcaaatagaggcaaaatttgttttttcttcagtaggagagcaaaatcaattaaaactctaccagacaggacagaatgtgtgtgtctatggacggggatgattttgcattgcttttagttattggcaatttacagagttgtaaaataactcccccagaattggaatcatcagatatcacagaaaagtatgctaagacattgcccagttttccactgaaacacatttttcccctacatggctcaaacaggatgaagccatgggttcaactattgaagtttaagtgagtgtatccatacctaattttcctttctttcttttttcttaggtgaactctactagacgatgaagtaatgcctgcatgtttttctgtcaatacaaaataatcaataatttgctttacagttttgagaaaacccattgatgctatgacaaaggttgcctgccttttccattttgctgctgttttcatattttttcttttttcttctaaacatcttaatgagtcagaagtatcatgatagaaaactgttaagctggtattatatgataccagatacccttgaaaatatctcatctatgcagtttcaccaacatttacacaagacttgaaaagcacccaaggtctgtcatagccagagaatattttctcctccagcactttctgtaaggtgtgagatcatttgatttgtgcatgagatcaaaataccagatcaagtgcatcagtgaatttctaattcttggaatgccttgtgacagtcactgtcttggcctaatcagaattgttatttactttagaattgccccacccatatggtcctctcaacagttcctggtgtccacagcccaggctgctgtcagtgttccagttccttgttgcattcataattgctccaaagtcattcttcaatgtgcaaactctttctgcctcaaccattatcagttgaacaagtatatttctatggtttgtgctgtttctgttcctgaatgcaactgcccaaatccatggcaaaataagacctttaggatataagaatatgaactcttcttgaatactactgcttttcatgtcttcttcttacgtcttccactaagtctgcagtaagagacttgcagcccctatggttataggtggggaaaaaacaagagtgttgtattgagacctgccttcaggcctctttcatttttccaaatccctttcttctatgttttctttttttaatttttattttttttcctatcttattgagcaacttctcttctctcagctatagtgcctggagataaaagctgtcatattgcagcttaaatacagtttcaacatatttcagtagcagctatacaatttctatagagtcagggattaacgtcagcagtttggttggaaaaaggcagggagaatattgaaaccatgttcatatgacacttgacatagaattgaggaaataacaattttccatgacaaagaatgagaaggaacaagtatgtattattggggatctgaatgcttgatccttgctacctcctaacctcttggccctacagctgactctattatgccctttgagaaacatcgtaaacaaaagtagtgggggtggggttttacagaggcaggcagatgagggagtaatccacaagtttatgggagtaatgaggtaagatggagatggaacttatcttgaaatatgtgagagcagagtgatcatttgcactcagccatttcttaattcttagaacgcaaaaggatggggagacttctcaaccttcactgtgttccaacttctaggaatttaggactcatgtaaagtacaatatggtcacctgtcacgtgtggtttgcattcctgttctttctgcaagtacatcatagcatgtcccccagtttttcaagtatatgacaaatgtgatttaacttcccattacagtaaattacgatgtcgaagacaaacaaagctagatgttggttaaagacgtccagcagttggttaagacagattttattcatataataactattacaatagggaagagagtctattgtaaactgagctcaactttgccagagcaagagacagaagtgttcttagatgctggggtatgctcaaggaaaggcactgattggtgttaagcatggtgggggagcagagatcagaccatgtgattgggccgtcagggtttgctaactggtgcttatccagaggagaaacaaatttctcctatctttctgtcagaaggtagtaagttggaacaaggtgcccaccaaatttaggcctttatcttcccacagggactgagagagaaagagataactttttaaacttttgcatttcttttttttttttttgctgttacttcacctttatttttttatgttctcttttttaattttattattattatactttaagttttagggtacatgtgcacaatgtgcaggttagttacatatgtatacatgtgccatgctggtgtgctgcacccattaactcttcatttagcattagatatatctcctaatgctatccctccccactcccccgaccccacaacagtccccagagtgtgatgttccccttcctgtgtccatgtgttctcattgttcaattcccacctatgagtgagaatatgcggtgtttggttttttgttcttgcgatagtttactgaggatgatgatttccagtttcatccttgtccctacaaaggacatgaactcatccttttttatggctgcatagtattccatggtgtatatgtgccacattttcttaatccagtctatcattgttggacatttggtttggttccaagtctttgctattgtgaatagagctgcaataaacatacgtgtgcatgtgtctttatagcagcatgatttatagtcctttgggtatatatccagtaatgggatggctgggccaaatggtatttctagttctagatccctgaggaatcaccacactgacttccacaatggttgaactagtttacagtcccaccaacagtgtaaaagtgttcctatttctccacatcctctccagcacctgttgtttcctgaatttttaatgattgccattctaactggtgtgagatggtatctcattgtggttttgatttgcattttttgatggccagtgatggtgagcattttttcatgtgttttttggctgcataattgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtactgcctaggttttcttctagggtttttatggttttaggtctaacgtttaagtctttaatccatcttgaattcatttttgtgtaaggtgtaagaaagggatccagtttcagctttctacatatggctagccagttttcccagcaccatttattaaatagggaatcgtttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgccctccagctttgttcttttggcttaggattaacttggtgttgcgggctcttttttggttctgtatgaactttaaagtgtttttttccaattctgtgaagaaagtcattggtagcttgatggggatggcattgaagctataaattaccttgggcagtatggccattttcacgatattgattcttcctgcccatgagcatggaatgttcttccatttgtttgtatcctcttctatttcattgagcagtggtttgtagttctccttgaagaggtccttcacgtcccttgtaagttggattcctaggtattttattctctttgaagcaattgtgaatgggagttcactcatgatttggctctctgtttgtctgttactggtgtatgagaatgcttgtgatttttgtacattgattttgtaccctgagactttgctgaagttgctgatcagcttaaggagattttgggctgagacaatgcaacaacccttcatgctaaaaactctcaataaattaggtattgatgggacatatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaattaggcaggtgaaggaaataaagggtattcaattaggaaaagaggaagtgaaattgtccctgtttgcagatgacatgattgtagatctagaaaatgtttgcatttcaaagagacacccctctacctcctgcctccccttcacagtccttgagaagacagtttggggtggcagaatatttacatataaacaggcagagaaaggatttataattgcaaactttctaaagtatctgctctaagaggagctttaggggcctataagcctatcacaagcttttgactggaacaaacagtaaattctcctggcagtattgtgctttctggtgcaggctttttttttttttttttttttttttttctgagacagagtcttgctctgtggcccaggctggagtgcagtggcactatctcagctcactgtaacctctgcctcccaggtttaagcgtccctagtaactgggattacaggcacacaccaccacgcccggctaatttttgtatttttaatagagacagagtttcaccatgttggccagactggtcttgaactcctgaccttaggtgatctgcccacttcagcctcccaaagtgctgggattataggcatgagccactgcgcctggctggtgcaggcattttaatgagggtaggatgatctttgggacacagccttaaactgctagaagctatgctaaagttaagtctcttagtggtggaatttgggtggactgattattgctcagaattttttgtagttctcagtggaagttctttttttaaataacccactagtgaccttattgttgtaatggtggacattggcagtgaaagactatctttgtaccagattacaaccctgtaagcttctcaaacactcagaaaaatccaagaattctcaagaaattgaccctgttcagtcaatcaagccagacaagcatggggccaggtggtactgtgagatttcttggagtccagtgaaaacctaaacaaccaaacaaacaaaagtaatgtgacctagttaccaaaatattacgcttcttctttgtcatgatatgtatatgtatgtgtatgtctccctttacaggccatgtagtatatttcccacccttaatattaatattttgtaattgttacagcaaccttaagaattttcctaggctgctattcattaaggaggatactggccctgggctatgcttgcagcttccagctcctcccagcgagctattaattctctaaaaatgttttggtacttaatatgctgcctcctaatttatagcatctcactaagaaggaaacaaaaacaaaaaaaaacacctaatgttgtttgacctctgctatatcagcatgagggacacatctgtgtctcaacagctaataaaaatagagtcacaagggtgatgggcaaattttggtgagtgatttttgttgttgattaccacagacactagaactaaaatttcagtaggttgctactgattgcatgtcatggaatgctgggccatgcatccacatcagtttaagtaacagtggttaactggttaagtcattttccagacacagaaaaagtttgaggtacatattttttcttggtaatccaaaagaacttccacatcatcacgtaattgtttatttgctatttttacagacatttaaaaaatggaaaaacagaaagattcagtagtcatttagcttttataaaagaagcagatgccagggccccacctacagagatctgacagagttggtctgtccacacagagcctagatttttacatttcatcaagtgattttgatatatttcaagcccacacattgggaaaaactgctttcagacacttaacacatttaaacagagaagctttagctcaagtttgcatacaaaaatctataagtgatggaagcatataattgggctgctggttgagaaaggcagaaagcaacaggaggccattgagataaagaggaaaaatggtaagaaaattaggccaactatttgtagtgcactcatttcattttcttgtttagtttacattggttagaagaagatgacatggactaagtgtaaggtgaggtagtgggagtcgagaacaggaagaccactttagggtggggaggtctagaataagaagctgagcttagaatgtgatgtctgtgtgaaaagaactttagagatctccagattaaaaagagatctccatatttcctaataaggggaaaagaaaagatatgtccaataaaagagaaataatggggacttctaacaaatattgatgaagtgaaggaatgagacttccaagactgggtcataaaggacaccacagctgttctttgctctctcaggtcattctgtctggggaaagccatctgccatgtcataaggacactcaagctgtcctgtggagaagcctacatgacaaggaactgaggactccttggcaatagccagtgacgagtttaggcctttagccagcagtcgtgagtgtgccattgtggaagcagagcctttggcccataattttcaaccaaaggtgattttatacccccatggacttgtcaatgtctagagacattttggttgtcacaactgggaggtgggggtaatactagcgtgtaatggttggaggccatggatgctggcctcatagatatatgaggtatatattcatccccaaatatcagtagttccaaggtaaagaaacctgctcagtcccagtcaagccttcagatgactgcatcccagttgacatttggactgcaacattgaggcaggatatttccctgacctcttcacgggactcacagagggagtgcctcatttactcaacccacagttcttgactccttgtgggaggaagcacacaagtgagtgaggcaggaactggagtgcagaggtgctagaactagccagctgctttggcaccagcaggggtgaacttcattcacttggacctgctgtgatctgcccctggtgggaggaagcatgcaggtgagttggtgcaggagccaggatgagcgcttttagggtgccagcaggagtgaactccattgtgggccctgcagcagcacctggagggggtgcctgcaacccatgaagccgcagaggcagctgccttccaccggtgagggcaaagggtcagtgtgacagcctttttgtatccacactcttggctcctgagcccttatctagcatctaggagaatggaggtcacacgaatgaattgaaggatggtaaatgagggggattttattgccaatgaaagtggctctcagcaggaaggggagctgaaaaggggacagacgagatgggaagataatcttcccctgaagactggccatctccagatggatttatctcagaagttaggccctcaaggtttccctctgaagtcaagctgcttctctcctctccccaattgtagcctccaacatctagctgcttctcttctctctgctggctgagcctggggtttttataggcagaggatgtcaggtagggcaggccatgggtggttttggaaaaggcaacattcaagcaggaaaacagggatgtcagttctcactttgagctagtctcaggtttttcggcttgagggtggggctttgacagggacccacccctgtctgcctagaatttctcttcctcctgtccccatcaatgtcatgagagattttgagccacagccactcagttcatctgctccaggatttctgacctttcaaatgtgtgtgagataataaatgtgttgttttaagctgctgagttttgggttatttatgcagcaataaataactaatacagcccccaaaatgtttctctagggttggagtagatattttaagtaaccaaatcaggctggtatttggagggcataagagggacagacagaacatgaataaatatttctgctaaatagcatgttgggcagtaaagtatattttattatcatagttcatgagacttaccaaagctcaattagtgatgattataacaagtggcttgttaaagctgaaacttacatgtttcatacctcttggcagaaagacactggtaactgtcaagatttccaggaataattaagagtgctgaatgaggcagcaaggccttatggaatcagtaagtaaagaaaaacagaagttgcatatttacaaactgaacagtgaagtgagtaggtgataaatagagaagctaccaggatagaagcaaggtatgttagagatgatgctgtcatctttgtaaactttagtggagggctcaaagaagagaagttgaggctgatgttctgcaaatgtgactgaatgcaaactccctggagagcctgtggaaatgcagattgaggggctgcagattctgcatttgactaacaagtcccaagagaaaatgaaagaacttgattctgtagagaggacatttcttcttgtaaggcctcagagatgaaagggaattatattgataagacacacatatttggaagatgagaaaagggatccattctcatacaactagttcaggtttttttttaaaaaaaaaaacaaaggtggtgggggtggatcaccataatcctgccaagagtgaaagtaataggaacagagggggaaagcagcagaggaagggcaatggtttggaatagctgcaaggaataaataaagtggcgatgagctgtgccataagagcgagggcctcatcaagttgggataaataggatttactgagctacagtacacaatcacaggaacaagaggactagaagcttcagcttttagaaatgccacacacatacacttctaggtggcaggggggtgcaaagccagagattacgtactactgcgggtgtcttttctttcaacgagactctgtggcagccaaaatttgtagctgaaaagtaagctgcacagagcagttagacaagagcactacattatttgtgcagttttttgggggcttgtgaaatggagctagaaataccattttttttcctggggttgcatgggatgcgaccgtaagtgaatacatcatggtgataggctggacatgacccctttccctcttaagtgaaggttgaaggagctatgttgaatgagaggatttaaaacacattttactattctcaagaattttatctctcattgcaggctttttggcaggtagttaagattccatgcaaatcattttaaaataaagagggttgtgtgctcactgactgtgtagtgttcagtcttctgaatatatcttggtgtcattttccaataaaatgagcaggaatataaaccttgggttaaaaataattcagaaatagcagttattctatccctacagcatgcaatgtgtaatctttgaaaacaaaattactcccagacacacagaaatgcttaatgtataaagcaaaaagctattattatatagtcatcttagatttcttctaaatgtgtgcacagcacaaataattaataagtgaatgaacattgttaaacatgcctgttcgaaagtctcatcattagttatttcattatatattaattgttttcctgtattgtataacttttttctgttgatatcaaggtaaataaaatatgattctttttccaaggatttcagaatctattaaagagacagctagggaaatttatacagcaatgtaataaatgatatgttaaagataaacattataggaaataattcttctccgtggaaagaaaccttccttggtggctgaatcttcaggtaacatagaagtttgccttttgatatatttttaaagtgttatacgtatctcccaccaaaaatatattattggtacaatttctgaagttttaaaaattataaacaattttatattgactctgaaagcaaattattgtctaaatcagtagtacacagtttattttactgagaaagttttatttgccttaactattatataaaatatattaaataaaatgggtttttcatttaaaatgatatactgtcttatttcttatatatcagaataaattccaaatggatcaaggattttcgtgttagaaatagtacagtgaaagtacacgaagacaaaataaaatgatttgtatactttcttaatgaaaaataaaggataaaattgtcacatttaaaaatattctacagtaaaaaatggcattaaaaaacaaaagaaaaaatgacaacctgtagtaaacatctttgcaacaaataagcattaattttctaaattcatagaaatatacttaaaactgaaaatcaaaggatcaataaaaacaataggatatttttaagtacatgaaacagattatgcaaacacacatgaaaaatgcacacttctttttttcgggtgtggaacattaacataattagacatgaattttccttcatccaattgacagttgttcacgggattggaagaatgtggagatacagataccctcctctactctgggaaagggagtaagatatccttaagacaaatttagtaaaaactgcaagaaattaatggagcaattttacttctacatatctatttatcctacatatctatttacatgtgttgatagcagtaatgctgattacagtattgtttgaaagaaaatctcaaaaacaatctaaaagctcatcactaagaactagatcaattatcatgtgtccataaaacagaatattatgtgactattagcaagcataatataaatctatatatactgctttggaattaattatatcaaagagatgtagatataggactaaacacacacaaacaagatgtcaggacatctttgtaaaattttctcattcattttaataaacacacatatgaccttgtattagtttgcactctgaaattactgatatttgacatttttaacctaaagaaaagggactctcatagagttccaactaatatctaaaagtagtttcttgaaggatagtcaggaaactgttaaaactgtttgcctctggggagagcatctaatgcagaaggcaggtgcaattttaagcttttaaacaagttcatgtattacttttcagctgaaaagggatttttttaattacacaagttaaaataaataactgcattggcaacagacaaaaaaattgagcaatatattgaaaaatctttacataatccctatcacttatattacaagaactttggtgatctcttacttttctttctttctttcttttttcttttttttttttttttggtagtaacctccacatgctggaatgcctcagagtacattttaatatgattgcatcaaataaataccaaatttgaaaatagaaaagcattaaaccaattacataggtgtccactttaggttttcttgaatgtcctgagaatggaaatcatatcaaacaaattgtagtgaaactttatagggtcattttctttacatatcctttccttttcctaaagaaccactcctgtttttccccttcccaaatctttagttctctagccctcatttcccattctcttttgctgcaatccacctgtctgaaccatttgcccaggtctaagcctctgtctttgcatctcagccctgcctggtacctgtccagcaagggactggaagctgctggtaagaaaggttgcttctccatcagcagtcatggaggagaaggcggatctaaaacattaagacatgccccctcttatctgtcacatcatgcctcatatatctattttataacaaccccctcaaaattggaaaataaaagatctctttaaaacttaagccaggtcatgatgtagggtctcaagatctgccctgcccccaccttgccaacctatgtggctctcttctctctcgtctctggctctcctcccctcatcacgctggcctccaagctctcattccaacatgccaggcaggcttccccacacacccgtatatctcaattcctacttcctcacctctttcaggttttaattcagttaccaccttcttggtaaaactaaccaagaccaaccttagaaaagcctttgatgcctaccttgaaatcctcatactttgctctttcactctctctggctctttattttttacatagcaccgatcacattctatataatatagcatttatttattttatgtatattgtttatcacctctctctctgttctgtctaggtcagctccatcaggtaaggggttttgttttgttttccattttgatgtcaagaatatatatcaatgtttgagatacagggagtgctagtcaagtaccttactttgagttgctgattttctttttcttctctcctgtttttacttattttttcttttttagatgtcaatattattttcaagtaattatgaatcagtttgtactttaatctgagatatcttgaagggataagtttattggtagcccatggtgatggctttgtgcaaattagaaaacaatgtcatttttgtaaagacaaagctgcaagttgtgtaacttgcagtgctaatcatgggctagtggttagactatattcaccctggggaaatacaggctaacacttgtgcaagaaaaaaggaaaaaaaaaactgtcacaactgtacattacaaatgaaggatgtaaaattactacattctataggcattgaaaagacaacaggaactattatgaaaaacgttatgtcaaagaatttgacaactttgatgaaatggacaaagaccttaaagatacaaactactagagttcgttcatgaaaaaatagataagataaataccctgatatttagaaaagaaattgaatatggtgttaagtagcttacacatacacagaaaaaaaaaaaaatccctctaagctcacatggttcacttttgaagtctgccaaacatttaaaagaaatgaaacaaaagaaaatctgattctacacaaactcttccaggatatttaaagaaggaaatattatctaactaattctaaggtcaagcattaccttgattccaaaaccagacaaagactttacaagaaaataaaaacataaaccaatattttccatgaacataaattcaaaagtccttaattatttagaaaattaaatccagccacactttatatagaaaagtatattgcatcataatcaaacaagtatttatcttagagacacaaaagtaaattaacatttgaaaattaatcattgtaattcagtatatgtactaactataataaaacatataaccatctcaaatgagaaaacttatttaacagaatccaacattcattcctgatagaaaaacaaaaaactcttgggaatgtaggaatggcagacaactttctcagtaaatggcatttatgaaaaatctacattaaatatactttttagttaaaattagaagtttgttccttaagatcaggattcagacaatatgttcatatttaccacttctattcagaattgtgaatctcaaaattattatgcaaagtaaaaaagccagaaaaaaaaaagagtatgtactaattgattccatttagagaaaacactaaaaaatacaaactaatctataatagaaaaccgattagtggttgccagggaaaggggactgtggaagtgggggcgggagagattaaataggaatagttagaaactttttgggtgaggcatactttcattattgtgattgaggttcatgatttcatggatgtatactcacattaaaatttattattttttgcattttaaatatgtgcagtttattttatgaattaaacctagataaaactgttaagggatacttttttcaatcatttttcacatgggaagtatatgttagctatgccattttgaaggggaagagaataaataggctttacagtttttatttttaaataaagctgggaaatgctaaatgggaatgaggaggctataattgttgactctttgacaatggaatttcaaacattaatggcttgttctagatagtacaaattcactgatttcattattctgagctcaagtaatctttgaaatctgggagtggatttattaccggagacataaggaaagaaatataataaacattgcaaatggaacaatcgtgaatcaaggttatattttagaattatcccaaacaatggcaagtgccttgtctagatattttcttccatcattaaaatatttcacagaaaatcatcaaaagcctggagaaatacttgtctggactttctacatgatagtcccggatgcaattatagtagtatagctgtctctgcaatttttttttaaacttttacacacattaaaatattctaggctgggcatggtggctcacgcctgtaattccagcactttgggaggatatttgataatttgaggtcaggagttcgaggccacatggtgaaaccccatctctattaaaaatacaaaaaattagctgggcatagtggggtggttgcctgtagtcctagctactcaggaggctgaggcaggagaataacttgaacatgggggtgaaggttgcagagagccaagatcgtgccactgcacttcagcctgggcaacagagcgagcgagcgagactccgtctccagcaaaacaaagcaaaacagaaaaccaaagaaaaatattctaaagaaaaaaaaaatcagttgttgttttaataggttcagaggtaagtttgccatatcttatttaccatgaatgactctagtaatggcaatgccatcaatgcctctcatcttccaatggttgccttttcttctgttattactggactgttgggactggtagcactggtcatataagatgcccacagttgctaaaggaggacactgttagaaataaagtgacggccgggtgcaatggctcatgtatgtaatcccaacactttgggaggttgaggcgggcaaatcgcctgaggtcaggagttcaagaccagcctggccaacatggtgaaatcccatctctactaaaaatacaaaaattatctgggcatggtggtggttgcctgtaatcccagctactccagaggctgaggcaagtgaatcacttgaacctgggaggcggaggttgcagtgagctgagaccgggacattgcactctagtgtgggcgacaagagcaaaactccctctcaaaaaaaaaaaaaaaaaaaaaaaaaaaaaaaaaaaaaaactggaaagaaaagaaataaagtgactactgcaatagataaaataaattgcccagctgcctccaggtttgctattttttcattatcagtgttttcttgacagtgttaaaacatttggccccctaaattcacagtttattggaacacttgatgaaagctgaatctctgtagtcatgctgttagtgactcactcttcctttgaaatgtctaatgcatagatttggtgaaatgctgttttcttaggaaagtttggtggacattaaaattgcttttgcaagtgaaattaaagacattaatgtaaagtggcagtgctaatagccagataattgcagtgttagaataaatttcagagtaattttgactaccaaccatctcttcacagctaaacttcagataaaaataaattttacatggaaccgtactgagatttctgctcaggatctttacccaattatctcttgcgttcctgttatttttttctaactgtttgagtttcatgtagagtgctctccattctttttctgtcaatttattaataatatattttgcttacggttcacttcttatcagtttaattttattttacttggacagagaatggtctgtagttttcttagtaagaaaactgaccaggctaagctatcgttgtttttttatgtcctccctcctttattttcaatgtcctccctcttccatttttagaacatatcctattttttctaagttatttatgtaagtcagatggatttactgttaatatgttaatctgtatatagtgaaaattaagaacctatttttcctaaatcatgcaggcatacattaattcctttgacaaatatttactgagcatttcctgtataccagatcatatgctaattgctgaaggttcttacttaaatatttactattccctcgtctgacaattactcactgggctcttactatatcctaggcattgtttcaggagctaggatacagtagttacagcaaaccaacacacaaactaactcaagtcctctctcatggagactgaattctattgaggaaaacagccttctccccagtccctgaatatacacccttactcacacatatatattttaatataatgtacacatataaatatataaacagcatattaaatatatagaatgtctattatatattgtaacaagtatatataagtaatattacatatgtgatattaaatacatacacaaatatgtatatatatatacagagaggcatatgttttaagtaattttattttacttacctccctattactgtgccatttcatagggctactaaaattattatgtgcctttctattattggtactctggtatatttgtgtgtgtgtgtgtgtttgtgtgtatgcgtgtgtgcgtgtgcacatgcacgcctgtgtgctgttgggcaggtgatcaatgatgataagtctgtagccagagctaagaccatgtgtgtggcgtatttatgtattcatgattataaaagtcccagtggtctgctgaggtggtctaggttggtctgctgaggttgggttgctatccaacacaaaacgcaagcactaatcaaatgtttgtttggataaagagcaagaacagatgctccaaatgaatacattaaacagagacccttgggtcattaaagcttcatgcctttgatctaacaaactcagatctacagacgcctcatcagtggtgaagctgtttcccatctgctgggggtggggacctagttctcatggagggttttgaggacaagcatctcttcctcccaatgccctgattataacaagccaggaaagagagcccaaagccaaatgcccctgccattgttggcgatattgatgtcacgtttgctgtacgtgaatagttcttcttctaaagtaatagattcatattgtttgctgtcctggctgtctcttttcttttctttcatatcttttgttgtgtttttaaagtgacttttatatatgaatacaaagcaactcacgaagtagggtgtgggttgggggcaagaagtgccctgcaggctttggactgtttgtccaccaggtataatcacactctgctttagaaaacttttaaagtcatcagcaaggctcaaacagactcttttaaaaaaaaaaaaatcatgaattctcatgagccaattcacagattgtatttataattaatagaaggtctggggtatcctatcctctaaaagatgcttagacacaaagagcagtccttgaaattatcaaggtatttgtctcaaaaccacacaggaaacaacttcagccctcagtaccagagacagacagtcaatcatagttcaaatagccacatggacaattcagaagagccaggctgaagctacagagcaagggaatggatatgtgccaagtgccagtgcccagctactgcactagcattttcacatgaactcccaggtttaaggccccctccacctctgggagggagcataacatttagatcctcttgacttgaccaaaaaagcttgggcagggtagaagtacatctctccctcaaataattagaacctgaggtaagagtcaacagcaggtataaaggctccataaaacctttgaggccacatggttcttttaactttataccttgtcctccctagcatgaggcttccatcctcaaggttacaagacagctactagagccccagccgatgtaactgtattccaggtaggaagaagaaaaagacaacatggggtaaaaagagcctttcttgaagcccatttcatgacttctatctgaaatctcttagatgattagatgtactcattgccattataaataaaaaaccatgttctcttaccaagaaaggagaataatatcggataggtaactagcagtctctgagcaaaaaggtataattattcccattgaaaactgagtctcaaagagataaatgaactgaaccaaggtcctcacagagtcagtcaatggcaactgacagttttcccagaggaacatctgttatggcatggaccacaggagtcacagcttgagtctaagcaggggctgaggttgtctgaattcatctgccattgaggtttcctgggatttaattgcataagtcaattagaattctaatttttgtatgagacaaacaaaagcaccagggtgtgcagagaatgtagatctgaaaaggactgtgaagggatgtgagggagagctataacctatctgggtatctttttttaacaatagcctcataagcacatatccaaacctaaggagttagcaaaggaggaaggagaattctaggatcaccaagccttagcatcaatcaacagggagtaaaaaagatggtattcactgacctttttgaaaacacagtgtgccctgagctcagcgagaacttcaataatgtcaatagctcatcaagtgtttgcagctttggggtgatgtgttcttgtcaagggaggacatgagcactgctgcaaacactagaaaatgatattagcacaaacactagaaatatcaggtttgtaagaagatacttgaggttacagccaaccttccacttgcttcaggttggccatcaataatgggtgcatttatagtaagccttcaattcccaaattatatctggagtttgaaaaaccaatggcaagaggcattgcctgattcaggaaacacatccaagccaactgacctgttaggtcactgaccacagttgaatgtaacgtttatgggaagcttggatcaacgaactgggcagccttattatgctgacccatggtatgtctactctttggggaggcttttcatgtggtgggagtaagaaagccccaggcttacagtttgatatttaatgtgttcaaatctgcttttctcttacacctttacccccatgcttctaaaaggaatttgtatgtccataatatatatcattacactgtggtgacaattgtactggggctgattcaaacttggagctaataaacaataaatagtttaaataatactgccatacaatttctgtcattactctctgcaccacctcctctcctccatgagtttcatcctgtccatcagttctctttagtactagctgattaaaaagtagatatcctgccaataaatctagtaagctgtgaaacatttgagacacacacttccgagactgttttcatcagtggtagattagtaacaatttgctaatgaagattttcttttaattattggggaaaaggcatttcttaattaataggaagattggtttcatccagattaattattgccgggaatgtgtcccaagcccactaggcacaagctatttaaagttatcatattagcaacaaagttaagcagcttggggtttagtcttaataatgcggaccatggtaattaagttgaggcttatggatggagggtcttcaggggggtccatgaactcataaaatttgatggaatatgtttcataactttctcagcttctcaatgaggcacatgatggccgagtatgagcaatagtctctggggtcgctgtcatccgtgttcccacagcatgcactcccaccgtccagctttcactccatgatggtccagtaactagtcattagtgaggccagaaatcagtgacaaaggaatcacagcctcgagttgaagagaccacaaagatcaccacaaccaggtctctcattctaatttttgtcactgaatgctgactaacaaagtgttagtatctcattttcttttcatcaatactctacagctcatgatccatattctccgccttctcacgatgatgtccattatttccctttttcagttttccatcatgatacatggaattcagctccatatttgatgaatatccttctattttcattcccagccattgttctgattgtttgctccatcccgttcctgaaacctgattgcaccttgttgaccttcttcagagaaggctgatttctatgtgccccttctgttcctcatgttctgaaagtaggtttgatatcctgctgattactcaagcccttcctatagcacgtacttcttcagttcttgaacaatagtgttattctttgagatacaacatatcacaattcatcctagcctgcttattatcatcaacaattttttgtagacaccatcttttattaaaatgttggtattatcccagttctacccatgaccttgacggtctcatctccagtaattttttcttccacttcatcatatccacccactttcatgatcacactttggatctaatcatcaactctgtactaattccattgctgtgctctcagaaaactttgtctcctcatgactggtttattcagtaatacctaccttgatcttttattaacctcataagcatctttagtcctttgatccctctttttttaataccataccagcaaccttaacattttcctttctttctttatcctgcttagattccttggcccatcaattcaggaacttcagtgcacctccacataacagagtgcgaagaacatttctgagtgcttatttcacatgaaatctcaacaatattttacccattgaacccaccctctctgtggtgacttttcttttccctgggcatccactctactagctttgctccaattatctggctactacttcattttttttctttcagacagtctcactctgttgcacaggatgagtacagtggcgcgatctcggctcactgcaacctacacctcccaggttcaagcgattctcctgcctcagccttcagagtagctgaggttacaggcatgtgccaccatgcccagctaatttttgtatttttagtagagacagggtttcgccaggctggtcaggctggtctcgatctcccgacctcaggtgatccacccgcctttgcctcccaatggctactacttctttacagatccatttgcaagctgagccttttcttctcagccatcagttgctggagagcctctgcttatgttctcaggcccccttcataaattactctgtattctctcccttggtgctattctttatcatctatgtgagcaagtcttcaaacctttattatagctcaaaattctccagagagatatagatgttcataactccttcccttgactgtcttaatggaaaattaaattcaacttgtccacaattaaaatgtcaattatcccatttaacctgattattttccaggtatgcttctcagagtgagaccctattcccatcaggttccatagtctgaaatcctcagccttccctctgacactactctttcccttatttgcatctaaaaaaaattgattttctgtctctcagatccatccatttcactttcatctccatttccaccaccatagcccaagttaccatttataattttctggacgaatgttgaataatttccattttgacattgccgtatggttaatcccttgaatcctcttcccaccatggctagagttctttacaaactgcagatctgacttctatcccaattctgaccctttatcctccactgttaaatccaatcatggcttcctgttgctcagtttgcttttccagaggtaatctgaaaatagaacactttattcttcgtattccagccatgtgtttattcatttttatacttggatatggtaataaatatttgtgagatgactttaataaatgcatgatacattatatatacagagtgtagtagggtacttgcacatcgtctagaaactttaatgcaacagtgattctacacaaacctcatttccatctttgggagtttgaacagcacctgatttaagttgaaagaagcagagttctgtgtttctgactggggtccacagcagagcgcccctgcctctacgtccattctcctcaccttgggttccaacactgacacaaaaatgagggactatagtcctctgaactcaggagtggtcaaaacataacctaaagcccaaaggtagctggaagagttgtgatatgattctcataaccaactcttctctaggtggcacacagagatttttgtcggtttactgaaacaggcaccaccctgaggcagtaccatggttctgagtgtaaacactgcccagatgtggctctttcatgcctcgggtgtgaggcagatgtgaagaatgatgtctccagcaccaggagcagggcttagcgatctgatgttaatgtgtttttttccagctgtgatttggatatctcaacagtggaataatttgcccaaagtacccgttgactctaagtagtctttagtgcggtgctcaaaaggctttacacagagatactgcctggaaggaaagctaatttttttttaactcacaggcctgagataatgacgaaaggagaggagaataaaattaaagagaggaagacttgagaggaggtgaaagtataccatctaccctggggcacccccagccaagtgatattaagtcttactccttgtcaagaatgtcagaatcctcttgtgtgtgtgctcccaacagttacttggaccttgggaagccagaattcaggaacatgagcagacttcatgattctgctagtaactctttgttcaccccaagaacagctctcaagagcccttctagcagtaacatctcagataacttcatgtttatacatatgtatgcatacacccacaggcatgaggaaaattttagatgcaaagctgacaacattccaaaatttttgtagaaatttgctaagcaatagaaatatatcagtgaaaataatacaggagctaaatttatacgtcagtttcttgctcaccaacgcagtttttcaatatcaaggaagtgaaaaattaaaccagcttcctccctccctcccttattttctttcttcctttctcttttcttctcctcttccctcttcttctctgcccgcaccctctcctttttaacttttatttgcctgtttgcctttacttttattttcaaagccctttgaggcagagatgaacttctggcagaatgtctaaaattagctaggttctctggaaatgcagaactatttatgatacagttggctttctcagtactacagagagccaataataaccactcttaaatgatcctgaatgtggctagtatgcttcattgttgggaaatctgattttattaccctcttagattctatatttttaatgtattttgtaaccaatgagatttccacaagaaataaggatttggccttccccttgatgagtcaagcctgcatattcccctatgagtcatgagtctgcatattattagattggagttgttcctgctagatacaggccaaatttaccccaatttgaaaatatcaaacactgtaatcttaatataatattttgatgtgtctattattaggaatggccagagcaaacagttgagatctgtaagttcatatttaggaccaagtttccatgctctgtgtagagactgagaagcgttctgagcctccatcagcagctgttgcgtccactgaataattcattcaggaaacaaggactgagtacctttcatgtgccagattatctcgaaggctctggtgaccttaggatgaacaaaaaattatgctttcacaagtagaaggaaacgagtatgaatttgggaattgtctgcctttacattatagattgcctctattttctggtgggagtttagcctcatgatattggtgagagccacagatcctgaagggcatgaatttaaggctcagctatgctacttcccatctgggaactgctgttaaagtcggtaaatgctcaagaaatcaatcagaggcccttctcctcgttcttctttattttccatcatcaccaccatcgtcacctataatcaccatgatgatattagatattggtgcaagtagaatcagagatgtgtattgtttgatccaaatattgtatgttgcaaattgaaagtctgccatcctataaatatgaaggagcagttagggagtttcagtaataagcaaaaatgaaggtaagtaacttggactagtcagccatttatgatggtaataataataataataataataataataataataataatcagaaataacaaagtaactgtgaagttgagatatttgaagactagtcccagtactaaggtgctttggggcaatgcgcagttttctaaaagtaatcattttcttgggttggacacagaataaatttttagtactttattttcctggttcttcagttcaattttgctacccaaacttactaccaattatggtttctttacttcaaaattccaaagctccccagcaatttgcagggtgagattttgtgtgactgctggaaggcacattccaaaacataaagaaactttgccattggcagaaatggcctttctgggacacattcatcaaaaatgtgaaatgagaatttaaaaagccgcaacatgccgggcgcggtggctctcgcctgtaatcccagcactttgggaggccgaggcgggtggatcacgaggtcaggagatcgagagcatcctggctaacacggtgagaccccgtctctactaaaaatacaaaaaataagccgggcgtggtggtgggcgcctgtagtcccagctgctcaggaggctgaggcaggagaatggcgtgaacccgggaggcggagcttgcagtgagccgagatcgcaccactgcactccagcctgggcgacagagagagactctgtctcaaaaaaaaaaaaagaaaacaaaaaagctgcaacatgtggcatcctccaccactcccctttggagcccaagtgacaagaagagagagtactttactgagaatcattttgtttagaccactgtaagacttaaaaaaaattaataactttatttcttaagtcggtcaagatgaccttgattctggtgattagaaaaccctgtgtctcctgaactccttgccttctttcaccctactctccctccctctgtcatttcttcccactcttatttcccactactcatcatgtctccctctctttgtctctttgccttctttcacatctctgttttttttctatctctccctcacaaatcaatattctcctcagtagtcaccccataaatgaagcacaaacacacatcaacaaaaatgtgcacaaatacatgcggcataaacacacacaaactcatttttgtccacattgcacagtaaattatcagagacttgataatacttgttaatgagctcagtcacgcttattattcagtcctatatcatttttctacacccaaatgaacaagtatggttgtagagttttggagagagagtacctgctctttatcaaacctgtaggaagattctctcatgaccaccatgttatttcaggcagtatcttccttccctagcttacctgtctagcaatagatttaaaggacatatgtaaagagaaacttaaggtcataatcttcaggactcacaaaacaggtatcttctcctgtggatcctaaagcttatacattttcttggctctcttcaagaaaaaaaacaaaacaaaacaaaacaaaaacacaaatttacaagcagagagaattcaccaaagttagcagagactgggagatccaggtcctccttttgtgttctttttaggcaatgcattgaaacatgtttgcatagagagtttcctgattgcaacctggcatctcctctctacctgcaattctctgcatttcccatcaattctcatcctccttagagggttgaacaagagatgaaccctgaagcctgggctccattctctgcacagtaagtccacctctgggaggcaataagcccaagttccaaccttcccccttaggtggaaggcagctgtgacaatgagcttgggaccctagcctgcatccacaatatgttgccagtccatgcacatagctcctcctcccacaccccaaggtcctcaccagtgcctggaaaacccatcatgcttcagcgtactatggccttaaaacagctgcaacactgtgactcctttgtctctttcttagttatgtcactctcagtaagctccagttgttacaggagaatgaatctctggctgggaccttaccttgggtggtgttgttctcattggttgaaatatgttaatgtgatcgaaaagcccagagtatctggtctgtttttagctaaatatggattaaggtcatttcagaaactggctaaagcaagcatctttgactccccgttaaggagcagattgccttgaaagtctttgatctagcctggatttgtcatttttgccactctgaagatatatggagcagtggattagtgactgtcattctttggaagcactgctgaacagggtgcagagcttggacttcaggttggacagctctggtttctgagttccaatcttgaccctgtcattggctctgtgacctcacacatgtggctcaacttctctcctctgtatttcatcctttgtaaaatgaggtaaacgatacttcataggtggtaaatacctgattacagagagatgaaccaactcagttgaaaccacacacctattcaaaagtagaaccagaattagggatgctccaatgtcacatgtgtgattcctctacaagaacaagtgggagataattaggcagcagtcaaaaataatgtgaagctatgctaacatctatttatcacaggcaaagttttgattaattaaatgagtgagaactttgttctttggcttcccctactctcttcactgtctatatctccctatccatcctatatttaaatggttatgtttcccaagtttcgggcctgaactcttctgttttctttctaggttttatccttactgatctctaatatcagcaaaatttcagttgtcttctctggcgtgtaagttgtaaatttgcttttttaagaaagcccaaatcatgaagatgattttcctgagacagtgaagactaagctgagccagaaagaagcaggcctcaagcaggcgagagtactaggaaagaaatgttttaggcagtggggacagaaagtgcaaagggtgcctggtgagaaggagctgaggccatgaggagaatggaggacaggccatgtggccagagcacaggagaggggtggcaccagaggagactggagaggaggaagggggcatctttttatattgattttaaggaaaatggggtattgatttgtttgaaaatgcacctgggtgatagacatgatcagatttatggtaaaacaaacaaaagaaatatgtgaccccatggcaaacagaagatttcaggggctaatgtcaatgtggagagtagtaatgagctttctgccttcatttacgactaattacagcagcttgggtgatcatggtggtggggaggagatgtaagggggaatgctgcagcaggtcctcaaatattgtcattttgttagactattgacaagggaaaaacaaaacaaatcaaaacaaaacaaatcaaaacaaaacaattccaggcctgggcccctgcctgtgtggagtttgcatgttcccctcaaatctgcatggtttttttgttcgttggtttgtttgtttttgtgatggagtcttactctgtctcctgggctggagtgcagtggcacgatctcggcttactgcaactttcgcctcccaggttcaagcaatcctcctgcctcagcctccctagcagctgggattacaggcatgcaccaccacacccggctaattttttgtgttttcagtagagatggggttttaccatgttggccaggctggcctcagactcctgacctcagatgacccacctgcctcagcctcccaaagtgttgggattacaggcgtgagccaccgtgcccagcccttcatgggttttctcaggtattgctgtttcctcccacatcccaaagatctatgcatgaggtcaattgctgcagtgtgagtgagtgtgggtgcatatgaatgagtgcgccctgagatgggatggctggcatcttgtccagggctggccccgccttgcaccctgagctgctgggacaggctttagcctcccttgactctgagcttgaataattgggtaaataattatcttactttttaaattcatctttcttaaatgtatatatagctcacatttgtttcaatggtaaatagtagaggtctttatttaaaattgtgtgatatttttgtgaccagaaataggcagtaggaacttaactcttatttatatcaattagcctatagtaaaattgttttcattatactgtattttgcttaaagtggcaatttctaagaacctattgatgacattaagtaaagacttactgtatttggaattaaggtgacatagattgctgacagatcagatgtgggaatgaaggaaagtgagaggtcaggataactccttgattctggcttgagtgcagaatgagtggtatgaggtctaccaggagagagcacactggagacaatccaaagtttgggggttgggggatggaagaatagcctcagctataaatcttcactgggctttcagacaggttgagtttgagatgactttgcagtcgggatccatgtgaagataccaactagaaagttaggtctggagctcaaaggagaggcctatgctaaaaatataaatatgtggagtatctttaagtaagtgaccatttaagccagtgtcatgaattcaaatgctcagagggaaagaacatagatccaggagagaacgatcctagggttcaagactgaaccttggaacttcagcaataaaaggcgggtttaggagaatgattgaattagtccagcatacaagatgttcaacagtgttgctgggcaacgtcagggtagccatatgatttcttgtacaaatgaggggccttttgaaagtgaaagagtgctaaccaggagtatcaaggcaacatgtgtaaactgggactctgtatggcaaaattagacaaagcaagtagttagatttattcaggttggaattgtgacagatatgcacaccaggaaaataaagagacaagagaactcaatatggaattagtcatcaaatgccatctagttgacattcttgcctattaatctcttcctgcatgttactacataaactttccacactatgtattttttcatattgcctcatttttgttcaaaaacaacaatggctctcagttgtcagggtgagagtttagaatccctagctaaaaacccaaactcttagttcatctggcctatctttttaatctctcatttactttaatctctcattagctttcccgagagtcatatttgcctttttactgacacttaaacatggcttaagtatcatcttctctagacttttaataagtaattgaatatagtcccctttatgatcccagcaaggaatgagccttattgtctatcagtcatttgaatctactaggaggatggttcatccagcactctatatctgataacatcgggagcatcagtttccagggaagtacattcaggtaaagtgagaatgttgtgctggatgcgaagtctcagatctctcagatgaagtcccgttttgttccccacccccacctgccgtaatgaattctttaaccacctgatgggttctcctgcccactgcacaaacaaaattaattcacataattgcagaaaagaaagagtttaattgacatgaggccggccacaccatgggggagagggaattattatctcctcaaaggcttctagattagggggttttatttatatttatttatttatttatttatttatttatttattttttgagacggaacctcactgtgtcgcccaggctggagtgcaatggcgcgcctcggctcactgcaacctccgcctcctgggttcaagcgattcttcctccccaaccccctgagtagctgggattacaggcacccgccatcatgctggctaatttttgtatgtttgtagagatggggtttctctatgttgacgaggctgctcttgaactcctgacctcaggtggtccgcccacctcggcctcccaaagtgctgggattacaggtgtgagacactgcacccggccttggggtttttcaaagattgtttgggggaagtgatgggagtggctagacaatggttgtttgttgctgattggttgggggtgaagtcatagggttatgggaaatgttcctcctgtgtgctgaatagtttctggtggggccacaagagcagttggtgagtccaggtgaagccaggtgtcagacatgcaaagaacccgaaaagacatttcaaaaggccaatcttaggttcaataatagtgatgctgtccacaggggtaatcggggaagttagcataccttttgatctcttgaataatgactggcaatcctttatgtctacaccttagcagaattcagccccctctatctgcctagcctggtggtctctcattagctttacaaaagtggttgagttttggggaaaggctgttatcatttaacctataaattaaatgcctcccaaggctagcttggcttaagcagccaaggaataattaaaagcagtttgaaggctcaaggcaagaggggagttggctagatcagatctcccccactgccataattttctcactgttataatttttgcaaaggcagtttcagttctagtactctatctgggatgtaccttacttcacttacaaataagcacagatcatattttgtatctacataactaggcaagaaccatcctgaaagggtaacaaattctatgaatccatccaaatataaaaatattcacacgatgtttctgtaattccacacagttagaaaaaaaatcatataggaatcagggaggtgtattctcattcaataatagaaacaaaatgtctttattttgcttaaaattaacaggaaaaagcaacagcattgcagtaaagaaagagtttcattgacacgaggccagccacactatgtagaagagggagttattataggaatcaacagaaaaaagtcccagcccttctgttcacatgctttaaaaaaaactatcataacatcaaaattgaacttctgtcttcattaataatcataagctaccacatattatgttgattaaaaaaaaattgaaacatctgcttggattgccttaaggaagactaacctgttttcctgctaagggtgtttgcattctttgtaactctaaaggtgaaaggacatcaggggaccgcccccagccaccctcttattcatgttcctggatcacagaaaaaggtgaacatattttggtctgccatttctatttgtggtttttttgtttgttttttttcaagatggagtctcactctgtcacccaggctggagtgcagtggcacaatcttggctcactgcaaccttcacctcccaggttcaagcaactcttctgcctcagcctcccgagtagctgggattacaggtgtgtcccaccactcctggctaatttttgtatttttagtagagacagagttttgccatgtgactaggctggtcttgaattcctgacctcaaattatctgcccccctcggcctcccaaagtgctggattacaggccggagccatggcgcccagcctctatttgttattctctagtagaggactctgaattttgatttttttctttgaacgtttttttttctattgtagtttggagttgcttttaaggggagttaacgcatttgttgggctctaggtcactttgaggcagagaaaacttcaatcagacctcttagttttcttagatatctgaactcttaatctggagcatgcattttgtaatttaaataaaacttttccctttattttcttcaaaattatctttctttctttctttctttctctctctctctctctcttttttttttttttaaaagcagggtctcattgtgtcacccaggctggggcgcagtggcatgatctcagttcactacaatctcgggctcaagctatcctgtcacctcagctttgctagtagctgggacaacaggtgtgcaccaccacacctggctattttttgtactttttgtagagatgggggtttcaccatgttgcccaggctggtctcaactcctgggatccagcctcagcctcctaaactgttgggattataggcgcgagccactacacctggcccaaaattagtttcatttgagtttacatggggtggttgaaagttttggggagttttttgtttgtttttggaatcagtttcagactatgcactttttggtactgacacttttacacacaacaagatcattcatgcaaaaatgaagaaatagaaaaatgaaactcttgcttttttctcatctttctctggcttttcttctcttatggccattttctccctctttcttttttactgtctgaaactcttttcatagacttgaacactgcttagaattatagaactattagcaggggcaaattgtatgcatctgcaatactacctcaattcttgatcctcagaagaaagaatttgaccaagggggtgtaaggcagagtgagagactgaggcaggttttagagcaggaataaaagtttattaaaaagttttagagcaagaatgaaaggaagtaaagcacacttggaagggggccaagtgggcaacttgagagtcaagtgcactgtttgacgtttgtcttgggttttgtatgttgcatgatttggtgggttgccttacttctccattgattctccctttggagcgggctgcccacatgcacagtggcctgccagcgtttggaaggggccacatgcacggtgtgtttactgaagttgtacacatgctcacttgaggtctttttcccttaccagccaagtgttctaagaggaaggacatataccagttaaactccgccattttgcctcttagtgctcatgcttgagcccacacacataactcctgagatcttatcaggaagcggctgatcaccacttcaggtgtttcctatctattgggagactgcttttccctggtcactcacatccgtgtgaagagaccaccaaacaggctttgtgtgagcaacaaggctgtttatttcacctgggtgcaggcgggttgagtccgaaaaagagagtcagcgaagggagataggggtgggaccgttttataagatttgggtaggtaaaggaaaattacagtcaaagggggttgttctctggccggcaggggtgggggtcacaagatgctcagtaggggagctttttgagccaggatgagccaggaaaaggaatttcacaaggtaatgtcatcagttaaggcaggaacagaccattttcacttcttttgtcattcttcagttacttcaggccatctggatgtatacgtgcaggtcacaggggatatgatagcttagcttgggctcagaggcctgacacctggcactggcttaaaccaattgttattttagaaagacagtgtgacaactgcctgaccatcacccgacggtcgcctgacattcttagattgggggcccctctcctgctttcctcacgcctgcctgactacctactccaacagagcaacagcggacattaccagagtttttttttgcctaagagatcactctgcctccaggactgtgggttctgatgcctactgcattttatggagctcctttcctcagaagagtgttgacaggataaaaacaaatcctgggatcatgtcttccttgatatttctgagcaccgtgtatacatatgtatgtaatgatggactcacaaatatgccactcttatactcaatatttgaggtggacaatctgacattggaaatgtagacattgttgttagacctggatttcaatttttatgctttgttttgtgatgttgactgggctgtattaaatgtcttgagttttagtttcatgatctacaaaagtagagttataatttgaaggagaactgaaaggacttgatgagatgaccattgtgctgtcttgtacatagtagatgctcaggaagtgttggatcttttcttctcactccgtctgactctggactgttgtatagtcatagtcaaaaactttgtagccaaggtctattataaaactagcatattcatcataattatggcatttcatagcaggtggtatgtcacgttcaatgctcagctaagtaattgtttaaattccatacaaaaaacaagtatttttcttactctagtgaaaagaaaaatcttgcatttacaaaatcacttgaaataagaatttctggtatctaaataaaggaatataataatataatagttaatatttacatagcattttctgtgccaggaactgttctaagtctttacatatattagctcatttaagtctcatgatgactggctgcataattagtgaggtcagtccagtgaaaaataatgcaaagctgcttgttcaaaaattattaagaattttaacatggtgatgccagagcattaaactaagagtggggcctttctgattacagggcagtgtacaaatacccaagtgacatatctcaatcttcatatcaactctatgagataaacaccattattaattgcagacaaaataattacgaagtggggaaaagctaactcacacaaggctacagggacaggaaggtttggagctgggattctacccaggtaattagtgttcagagtctatgttcttacctactggaaaaaaaaaagaaaaaagtcttttgtttatgtactaacctttattttataaattgcactatgtattttatttcagagctatgatatcaaaatatctattttgatatgatcatatagtataccatattcatctatatcaatgccatggtttgtacaaatagaaaaagatctgatgggaagcattatccatgtagctagttacaccaaaactaatatgaattttaccaatcaccaaacactattctaagccctttacttatattaacatcatataactgttaataccaccctatgaaataggtactattgttgcaatcatagtattttagatgaggacattgaggaatggaagacatatatcttgagcaatgcctcacatctaataactgctaaggtgaaatttgaaccccaacaggctggttggggtcttcaaggtactttatgttagtctcttgactgtgatgaatgaaatgtgccattgttttaattttatccactgctaaatcaccaataatcagcagaatgcctgacacattaaataaccaatcaatgtttgatgaagtaatgaatgcactgagtcctttgaaaattaaaattttaatcatgcaagtaatacatggacacatgcttcttctaaaatgctaataaaatagtctaaagaaatcaaaccataaatgtcttaccagaccactctcccgcccttgtcatgattttaatctttattctctggacttttccaggaaggaccaagatttccaggagtgttctgtgtttatgaatcgctgttgatcatgctatgagccgacagggttgacgtttgctctgcatactcaatgcagctcaatatgatcctgaatatggtgaagctttcttcagagccatttcttttgctgcagacacataataaatgccctagtttcactaggcagtttcagtggaattcaatttgaaagctaaaaatgatgcagataattataagcagcttcaattccagttactgtccaatccctgcctgaaagctccttgccaagggatgttagccacatgatcctgtggctgctcaaggttaagctgttctgggcaagagtttaaatgtgctgccacagggcaggtttacttctttctaaacaactcaggctgttttctctagagccttgaagcccagggtctagaccagacattacaggattttatgtcaaagaagagtataatattaaaacataattggggcatcgctcatggttgttaagactgacttgtgataaaaaatcatgtgaggaaaaaaaactgccttttgggtaagctttagaaggtggcaattaaggaacttgagttttggagcaaaattgccttatttgaaatctaccactgccactgttgactgaacaattgactgattctgtacaatttactatattttctgaaactcagtttcctcatttgtaaactggagataataattgacttacctcataaaactgtggtaatgtcaattgaaacaattaatgtgaaatacctaatatgctgagattctcaataaatattagattttataagcttcataaaattaaaaagtgcaggagaaacaatttcagaataactcagtccagttggaaatattatgccaatatttttgctgaaagctggtgaaatcttcagcagggactggcagaaacaccagtgctttactaggcttttcttgggcataatattctcctgaagtaaataaattgacaaataaatcaatacattgacaaatgtcatttgtcagtaaaagtgacaccttctaaaatgaaggagttactcttttggtttcattgctatttaatggtatgttcagaagtgaactgacttattaactaatgtgatctgagtgactgtgatggacattctcctccaaagctgatagagtgcctacaacacttcctgctctgtaataggcacaacataaatatatagtgatttgcaagccaccttttggaggagaacacttcccattgtttttatatcttctaatacaccagtgcttggtaaggtcctcacaagagaatgctgatacctgcatttctctttccctggtttcctgcacaggctatggtgggcgtaagctcagttctcaacaaccgcctgctgaatagaacactgggcaagggaacaaggggttttaaaggcactgatagctctcaagaggctgctctgtctgccaagagatgagagccatagaatcagaagaaaatttggagaataaaaggttcagaaaggtgactagagtaggaggaggaaaacaaagagactttaaagcgctcttctcttgaagcaccatgtcctctcactatttattgtttatcaggtacccttagactggatactaagcaaggctcgtcaccacaaaccttgtcacatgcacattgtcccttcctactctttggagctaccattgtgtttgtgaatatcacacactgttcacttagatatagatagatagatgaaagataagatagatggatagatagatgataggtagatagtagatagacagatagatagatagatagatagatagatagatagatagataatagattaggagatagaaaatgtctttgtatttatctggtgatgggaaatcttgaagtttggagtcaacctgatttagttagggtaaataatagtgcttgctctaacaagttgagtgaccttgtacagtttagtggaaatgactcctttatgggcaacaactgctgaatagttgattcattatttttaaaattatgtttaagagaaaagtattctgaagatccgaacatctcttaaatatgttatgtttgcaaacataggaatttattcaccagtcctttgatggagacttaaagcttttcttgtgtattggtgtactgtttaaatttcttacaaaactcactcccatatataatctatacatgtaatctatgatttctagcttcagtttctttaaataggacaaaaactaaaactctttgcaaattatgctgtggggaaaatttgacagatgtttaccacacaccctctcccaaacagatttgtgaaaatacagaccatgtcttaattttttttttttttttttttttttttttctgagacagagtctcactctgtcgcccaggctggagtgcagtggcacgatctcagctcactgcaatctctgccttccgggttcacgccattctcctgccttagcctcctgaacagctgagactacaggtgcccaccaccacgcccggctaattttttgtatttttagtagagacggggtttcaccgtgttagccaggatggtctcgatctgacctcgtgatccacccgcctcggcctcccaaagtgctgggattacaggcgtgagccactgtgcccggcctcatgttttaattttgtatttctccctccctccctttatctttcctttcttccttcctccctcccttcctctctttttcttcctctatctcttcctctctccccttgatcacagtatatactgtagaaccttgtatatagtagcatcatgaaataaaggaattaaattaataatgggtaacttgcctactgtaacacctaacaaacatataatattcaataaaaatgctgttaccattattgttgtcattatatgtatatatgtttatcattatgtttctacagaagcaaagtaaattggtgtctttaagataatattaaagaaatggctaaggaggcttacatgagattttcagcaaagttccaagaattgaaaaactataagtagcagatgcaacctagaattccacttaccttatagtgataaaagacactacattagtttaagtttactagcccatcctgttgaaatatgtgtgctcatatattttagtaatacttgtatttttgtggtgaaatggttatgcttccaaaaataacaaattccagtgattttagttcaaaacagttaagagctagagctagaaaacaactttcttacttgcattatttttctttacattttcctaaactatacgcaggcaaaaaaatgttgtggaagtgctgttttatggaaaaaagccctgaggtgctatttgcctgcatgctactgaactgagtttacatctttgcaaacaggaggcttcccggaatgtgctgtgtgtatatattcagagcgcccctgtgttcactgttttaagtattgggttagagatctcactaaacaataaagtagcattagctccccgtagacaggtaatcctattatctttagatacaaggatacattttaataatacagatacggagattaaagcaggaggattgagaaagcatcccattccctcagggataatgggtaatgtaatcatgctcttgcactaagcaaataaattagaagtcttgattgcatcacaatggaagagattcatacttccatttctttcaaaagtgatggcagtctgcttccaaactaaggccatttaacatgtctttatacattttttcctagtttttgaaaaatattttaaattgaacccaaaggcaaatacgtataatgctagttgatgctttgggggatatatctttctatagaaaccttcccttccaatgccattgaaaaccaaatttcaaaattgagcactagaagtaagccaaaaatcaattaccattgatggaacaaaaaaaaacagtacatttttgtcaatattactgctttctttttttcttttctagctttgaaaattaacccccattatgtatgacaatctctaaactaaagaaacagtaaaactcttgaatatattctttgtacagcctttaagtaattaatggagtacaacacagtggtctcgataaaagttccagaagaactcaggagggcaagagatgctgtagaaaggagagaggatcaaagctgtgtcttgcaaaacagaaaagattggggcatgaaaaaggtgtggagcaagcaaaggtccaaaaaattgttccagaaaaaaaactgactaaataggaatgtaggaagtatcaagggaagataatttgggcagattctgaagaacctttagtgccttgataaggaattagactttaggatatctggagtatctctcagcagggaaaaatcttgatagcaatgggtttgagaacatgaatatgggaagggagggtaaggcaagtcatctacgaagtaagaaggccttagttttgaatattaaatgataaataagaaaaaatatgaaaaatgaacaagcaagactatgtagatggccgaatagacagaggccccccccaaaacttaaccacaccctcatctccaagagcccaggtgttttttcctatttatcatctcagctgctcaatggctcatgcaattttaaagcaagaagaaataatgaaataatgatgaagcagatgcactgtgtaagtgcacacagggatgaataaattatacaaaatgcactgcagttggaaggaaggaaaggaattactgaaagaaagtagcttcatggttttctcattgagatcaaactcagtcctgctcagtaaaaacgaactaagtactcttggtctggaggcctgaccaggaccttaggaacttgtgatacaaagactggaagttgccctggttgagtcagtgagtgagtggtgaatgaatgtggaggcctagcacattactctgtacactctgtagactttataaacactgtacagttaggctacactacgtttgtaaaaaaatattttttctttaattgtaaattaagatagcttgctgtaacatttttactttataaacttgtaattttttttactgttttgtagtaatacttagtttaaaatacacattgtacagccatacacattgtacagccatatgaaaatattttctctctgtatatctttatattataagcttctttctatgcttataatttttgttttattttctacttttaaacttttttcttaaaagctgagatataaccatatacactagcctaggccttcatggggtcaggatcaccaatatcgtcatcctctactacatcttgttccactagagggtcttcagggacaataacacacatggagctgtcatctcctatgataacaatgccttctcatggaatgcttcctgaacgaactgcctgaggctattttacagttaacattttttcttttaataccgtgtactcagaaagagtatactctaaaacaaccataaaaattatagtatagaaaatatattaactagtaacagagtaatttcttatcatgatcaaatattatgtactgtacagaattgtatgtgctatgctttcttttttttttttattttttattttttggagatggagtttagctcttgttgccctggctggagtgcaatggcatgatcttggctcactgcaacctctgcctcctggattcaagcgattctcctgcctcaacctcccgagtagctggaattataggcgcccaccgctacgcctggctaatttttgtatttttagtagagatggggttttgccatgttgaccaggctggtcttcaactcctgacctcaggtgatccacccacctcagccccccaaagtgctgggattataggcacgagccaccgcgccctgccccatgtgctatacttttataggactgacagtacaggaagtttgtttataccagcatcaccacaaacacatgagtaatacagtgcactacaacatcgtgacgaccatgtcactagatgatgggactttttcagctccattatgatcttatgggaccgcagtcatatacgcagtctgttgttaactaaaacgtcgttatgcagtgcatgagtgtatttgatgcaacacagtcatctcaggaattaaagtggctgtgtctaagtcccagtagccctccgttttgacttatttccttttcctcaaaaattagatgccctttcaacctggtttgacaaaaatcactgaaattgatcaatgcatataggttttgggtctatgaaaaaatgcatattttagctctgaagagaacgataacagaacttgactgggagttgtaaatgtcagtgaataacgggttatgggacatgaagcatattttcagatttctcagagaaccatacttgggtccaaatgacttcatgttaaagaaacggaataaaatcaactcagcattcctgctgaccagctttctatctcagtaagtaagtcatcatgccctccggagcaaccatcttaggtcaatcaaaacatttggcctcattaaccactttggatttatcttaggactttcttatttatagtcttcccaaggcataatgggcttcaaaatgtacttttccctggttcatgttgagttgaaccaagttctgtgcttttactcagcaggcagtcatttgactgtcagcttttatatttttctctatgatcaaggagttcatacggctgctcctaggtgcctaattaacattcctccatcactgcatccctgcttgtaattattcttcatgccacctttgtttcctcaaccatcaggaatatatcaataggtcaaatcgttttagtacttctgacttagctcttctttaagcttcataattattagatataaactgcagataatacagatctcttatttcagcagattctgtgattctgctttttgtttgtttgtttttgtcaggagagaaattggactaaattctgaagagtggccatggtttgggaagatagaagagggtgctgcatatagggatattaggagcagagctaaaaggcaggaatcaagttgcatgttggtgaagatatgtgatgtgttcggtgtagagaggtacacccttgaatttgaaatgtaatatggtggggggaggggtggaataatataaaccttagaataagagtaggtctaggaagctggtccccacatcttcaactcaccttacagccacccagcaggcagacttatctcccaaatctggtccttttactctcttactctggttctttcaatgagactccagtgccttcagctaaatttcaaatgatttctcctgccattctagacattgcaggtcccagcacacatgagtttcctaaactaatcttcagtccttgctctcctgccaggcacctcacatttcagccacattcagtacatccttgaactcaccatgaacactcatttccacattaccacccatgtgctcacttgctcttatcttccacctccagtgcacttataaactcctacacagtatataagatacaggtaaaatataagtcattgtttgtatcattcctcagtcatagctatttacttcactacatgtacatccgatacccttgaacatatctgtattacaccatttaccacaacgtattatatttatgtacttacatgtctaatctgccacctagacttgagctcagcgtttttatttatccatgttccccttaaagattctcatatgcctgatagatggcaggtacctaatcgatgtttgttaaagtgttttggatggagaatcactaccatgttctttcctaaaaaatcccaggaattggtggtataacatgactggtcattgttaattaatgttttctactagagattgttcttagtcagtcttcatgattttttttggttaacaaatattttggggattttaatggccaaaattatttctaaaaaattgcttctgtggttgttggtcattcacttagaaaggatttactgaacacttccaattaatgagctaatttcagttttctgaatcacaacaatatttatttcccaagaagtaaacaaatttctgcatataaattagaattttattaggtagcagttttataaatcatgtagtttagaatggcattctcctagaacaaatccataggtcttttttagaaaaaaaaaaaagaaaagaaaagaaaatgtcgcctcaataattttagatgtaatttccatacacattttattgttgtgtattataggttgattactgctcctgatagatttttaagttgcttaagcatataaaagccccaatataattttccacagatagatggagagaaagaactttttaaacgcaactctataatttgtatatctgaatcctgatcttttaaagctttcttagtgttttccttagcagaaaaaatgtttatcattagaactgttaaggaggaatcatatctccttttataaagtgctttatttttcaaagtaaaggaaatgcgagatggcaccttataaaattgctgatcaaaaatggtcaaatgttggcagtttcatgtggttcaccctaatacttacagcttgattttttgagaggaaaaaggattgaaggacgtaaaaatgttatcttccagtaatctcaaaagatacctgagagagaactatacagtgaatgctgatgtactgattatgaaatgtattttcataaaaatgactgtaacctggttaaacaaggcatttttctcctggattctgcacacactagtagaataaattcagttggtttccattcctctgtcagttagtgcacgtaagtctcacccatttgtaatgtctagaaatcttaaaaagcatcagaattaccattaatgatgatgatcacagtctgctagatgcccaggaatgactaaagcctactactaaagccccagtagcagtcaatataggttatgcttcaataacaaacaagtacaccaaatccttatagcataacacaatgtttatgtttaaaattgtgatatgagttgaatgactttccagagcagattttggagggggagaatactcaattatgtacttttcattaccacaaactgaagtggcacattctcagttctagttacattttatttgctaggactctggtctcaactaattggaagacgaaagtgaagtacaatgaatgaagaaaggagaggaaaatcagatatggttgagcactaaacatctttaccatagtttgtaagactaaatagacttcgtacattttatttagtatttttttcattcttgcttggggaaatctttccaagatacattgccaaactggggtaaatgaagatgaaagaaagtctgagacctaagaggttgaatttcttgaaactattttataatgaccatttccttacttctttttgccttgttgattctttccttgttcattctatttaccacaccagacataactccacatagcaagattttgccttgtctgatgccttcattttcataatttatttccacacatataagcagaatgggttacaatggcagacagaaatctttagctttgaaatagaatggccagtgagaagcatgcctatatgaagaatctcatatagagagaaaatttaaatttcaatagagtgtttttcttaaacttagaattggccacttttttttttttttgtcatttcttttcacttcacaggaacatagggaaatcttaacttcagaagcaatttgcgtgcaatctctcttcctggatgggtgaggattgcccccttcagctcctgctaagctttatcaaatggagaaagcctcatttcatgcaggcaggagtggagagtggctctagtgtgcatgctatcctcatcctccaaaatatttcacataaataatatgttaccatcagaaacataaaatatcaattatatattataaagcagaatttataattctacatagagtgtaactgagcaaaaattccattgaggtataaaaacagaaaatgcaaagaatctttgctcatatgaaactgacaacatgccatctccccttcatatgactaaacctgctctcccaatcccattgtaccatttggagagatttacatcaatccagaacaaaaattactcactttaccttaagtattgttagcttccttatttcattgtatttcttcagttccttcagtttgtttttaactgaatattggtttctattggtttcttcagttattttttaaatgatgtaaaaataaagtttatctcatatccctattaaaatctctcaacactcatgtctccctgacagcccctgctcattctctttcttccagcctggtacttccttcacttctctccttcctcctctttctccttcttctcctcctctttcttctttctttttccttgtctttctcttgtttttattttccttccccctcttcttccctcatctggaagtggcttatgatgcacccgaatcagaatcccgacgaacaaaaattatgattatctcaaccttaagaaaaacagctggattctagaaaaccctcaaagaaagtacgagatttgggaaagaagcacaaatgtcccccaagtccctaccccactctctcatgccgagaaaaaacagcttcacaacacaaagcttttatgaagggctagcagttccagtgatgggctcctgagccctgagcctaactggtgcctgttgacctcactgctgttcaaatactgtcttcttgtcctaaaattagacattacctttatttgattttctctggcactgtctgcctgccaaccagctgcctcccctgccacccccgcacacactggtgatgcattccagatccaaatccaagtcctggttgctgacatgattccagatctcactgactgtgggatttgtctagaattatgaggccaagtctcatattttgagatatgaagaggacagaaacataaatagacccagaacaggatctcagtgttacttttttatctgtgtgaaggacaacgatctctccattttattctctctttaatacctatttccaaacataagaaactggaacttatgatgtgcctatagtgtcaaacattgctccaggcatggtacttgcactgtcttgtttaattctcacacaaacctacacaagaactgttatgattctccttaattgatgaggcgccaaagtccagagggatcaagtaacttgcaaaggctcacagtcatgtggctgagcagaggttccaatccagggcatgttagtgcacacgggctcttccctagtgccataattcctcccctcaaataagattttcctggtaatttgtgttttttgaaccaataagacttaccctaataaaacaggataaaaggtaacaattggcaggcgcagtgcctgtaatcccagcgctttgggaggccaaggtgggtggatcacctgaggtcaggagtttggccaacatggcaaaaccccctctctacaaaaattagccaggcgtggtggcagagcctgtaatcccagctacttgagagtctgaggcaagaaaatcgcttgaacccaggaggcagaggttgcagtgagctgagattgcatcactcactccagcctgggtgacagagtgagattccatctcaaaaaaaaaaaaaaaagtaacaattaattccatttatatgggaaaactagatatagagaatgtatgcaatttgttgactcttttttggtaaaaagaactagtactagaaattcaaactttcaagcttctagttcagcactttttcaatgatattgatacaagatattttgctccttagctcagctaatctgggttcttgtctcaagaccaggaagaattaggcatgcagacacattgaagggtgagaaggatggaatgtattaagccaaaaagaagctctcagcaaagagaggaggtcctgcaagcaggtttccacctcccaaattgaataccagggccaccacacaggagacaaagaggccgagctccttccctgcataaggcgtgaattcctggtggctccaccccattccccaagtacaggtgggcctctagtccattgtgggcatgcccaggcaagccccctgtgcagttccctcatctgcacaaaacatctggtgtaaacacttgtgggatgggttggagattctgcagggattcttccgtatctgcgtaggcctttgtctgcctcctgcctctatcaatatcttgatgtttagaactgaggggaaaaatatatggtaatttttgagactgtgaggcagagctacttccttcactgtaatattcatggccctgaatgctggccaacagagggtcaggacacaggaagggaagcagcatcttatagatgggccgcccctcaacactgtttgctgcgctactcgatgtcactatagaagatgttgctctaccccaggttgcctctgcccactcctgtcaatcttgtttttcacaattaattattgacctatttgatcttcctaatttccaattagccacattctactttgtccaatttccccaatcctatcccttagtataaaatcctgctaaattgcatttttttcaatctccctaagtaatgtgatacatgatgtcaagccaacagcattcatttattttaaataaacttacagctagaaattttgtttctttaaccacattgctagacttgaataaagtattttatttaatgaatggacgatgatgataattgcattttttaaaagagcaaaggaatcattaggtattgcctgttttccaacaatactagattttattttaaatatgtcataattatttctacctgaagagcactggcactggagctagcctgccctggtacacatcgtggctccatgtcttaccagcggtgtgactgtgtgtgagttactaaatcactccgtgcttaggttttctcctacaaaacaaagataataataattcctctattatataattatggttagatgcaaataaaattgtgtccagaatttattccttctggtgggttcttggtctcgctgacttcaagaatgaagccacggaccttgcagtgagtgttacagctcttaaaggtggtgcatccggagtttgttccttctggtgggttcactgacttcaagaatgaagctgtggaactttgaatcgagtgttacagctttaaaggtggtgcagacccaaaaagtgagcagcaactagatttattgtgaagagtgaaagaacaaagctccctcagtgtggaaggagacccgagtgggttgccactggtggttggcatggccagctttttattctcttatttggccccgcccatgtcctgctgatttgtccattttacagagtgctgatttgtccattttacagagtgctgattagtccattttacagagtgctgattggtgcatttttacagagtgctgattggtgcatttagaatcctttagctggacacggagcgctgattggtgcgtttttacagagtgctgatggatgcatttacaagcctttagctagacacagagcgctggttggtgcgtttttacagagtgctgattggtgcatttagaatcctttagctagacacagagcgctgattggtgcgtttttacagagtgatgatgggtgcatttacaagcctttagctagacacaaaagttcttcaagtccccactcagcccaggaagtccagctggcttcacctctcaaaatgatataggtttgggggaacttttaaaaatttgggcagattattttttggcagttattttttgttgctatgttttatcttcacgtgtttgtgtgtgtgtttgtgtatttcttaagaatactcaaacttggctgggtgcagtggctcactcctgtaatcccagctctttgggaggtcaaggccagcagattgtttgaggctaggagtttgagaacagactgggagtatagtgaaaccctgtctctactaaaaatttaaaaaattatctgggtgtggtggcaatgcctgtagccttagctacttggaggctgaggcaggaggatcctttgagcccagaaggttgaggctgcactgagtcataattgtgccattgcaactctagcctgggtgacagagtttaaccctgtctctaaaagaaaaaaagaaagaaatgctcatgttcttggaataaattcatttttataaatttattcaaattagttatacaaaaaactatgaggaacatatgtctgtaagaaggttcatacaacctcattgaacatgattgctcctagtaggaacttaaatagataacataagacaacatcaataggattttaaggcagccatttacaattacaatctcattttaaggcagccattttaaggcagccatttacaattacaattacaatctcaaataataattttataaaatagaatattgtatattatttagaaaacaaattacacaaatgacttcaatttacattaaaactcatatgtacattggacatgcagtaagaatatgaataacttccaaattttctgcagcgagcctgtatcaatttaaaatcagaatttatgtgtatgtatttaaaatatatatttaacgtaattctaccatctgacctagtaattcctaatcatttaatgtcccatctaattctttactgttgagtaatttgatttccgatactgtaatttattaaaataatgaagaaaaaggaaaaatatgtactaacatgtaaatttcagcatgatatataagactagaaaattgaaacacaaaggaacaatagtcacggaatcgttaaatataataggatcgcagtttaatatacgagtatgaaaactcatatgttaagagagaaaaactggatacagctatatgtgtgtgcatctagatatagactaaaatatatttttaaaatcctatggctatgactagataaagggctagaagaaaatttttgtaagttttgacagtaattacttctggggagaggtgtttctgttttctctctattcttcatttccaaaattttctcctattatgttatataaatttatagcgaggaaaataaagatattttattaaatgtaatttcttaaagaaaatattttattttccttcttccattgacaagttctctaaggtaaattttttctgactcctcccagatcacgtgtccaccattttattttatctagggaatgacaacctcacttatgtcattttgaagtactgcattatatgatatttggggggaatggcctctcccttaaaacctttacctgcaagcttcctctggagtctttttgagtcagcacctccatctgtggtccaagatgaaaaaggatgtactaaatcaccttgacagtcgtctgtttgcattatatcatcagtccctgtcttatgtgtggatgcaacatttcttcaatccattctttgcctctcctaagtgcacacattctcaggcagaatggagaatcactttttgttttgctataaaacacacactgacttttgagacaccttcccagaatgtcccagcaagactattattaatttttaaacagagataggactcccaagaaggaaaaccaggccatggtttacttcgcataatttaactgcttaactcaaaatattttccctagagaccatcacggtagtgaaacttttcctattataccattcattgacaaatttgtaatcatgatgtatgtgtatatacttatagtatatatttaaaatgggcattctgaccttgtagtttataattacaggattaacaaggctgaaaggaaattatgtaaattaggaaataggacaagagtgagggacaaacctggaatgatgacaagcacagggaaagatggttaagggaaaaaaaaataacttcctcttttgctgatttccgtattgtctagagctagccatacttagaccagcaaataagccaatctttttctgatgtttactcagcattttctgaggctctcctagcaacaagagtgttgcagggtgctggtcctgagaaggccaagcacatgccccctttgtggaactcttggtcaaatggaaaaaccaagtccaagagtcaagcaaaaggccaagagttttgacagaatgctcacaggagtgtgttcaactttacctgggaaaaagaaaatgagcaagcagagagatatgactttgtcttagtgaatctgaccgttttcaagtaaaatgtatagcacatactttgtccagtttgaatggtgatatattgcaaattaaatgaattacttaaaggccactgtttatgatttaatctatgaaaaacgtccctccattgcatttctgcatacgttaggtacttctgtcagagcatcttattctgctagtttgtttacacttgtttctctctcttctgaactgagactttcaaatattatggtacaactatcagatgctgatatataatgcttagaaaatgtagatgaagtgggaaaacaaaaagtttcatatttggggtcttataaattgctcctgttttaaggaagatccaataatcaaacatacttacaccactttttgttgttgaattcaattggcataaaatgacaacacaaacacaattttaacatgattgaaattgttggatgatgaagtaggaaaaagtgttagggaagtccggaaaagtaaacctaaacctgcttaaggtaactggaaggaatggaagtggctgtcaaactgaagaaaagttttgtaaaaaaaaattacagagaaatccatattcccaaggtgatctctggattttgtccagaagactcaggcagctagccatcttgtgatgatcccaagaaattcgttcatgaactttttcttcttagagaggagaggatcacacatattcattttctatgaccagagctcagagatacaaacaaacactacgtccaattttatgtcagtagattgtctaaaatattcagagtctggatggataaaatattatattaccaacaaactaaaggacttgtgggtactccaacagcacgtgggcaattggaatgatatcctttttaacgtgactttagtaagtcttaaattgtgttagcagcataaatatgtgggaagtggtaggaagcagagaaaggaggacgcttgctggtagctgggtaggggcagggaagttgaggggcctccagacctcatttcagaaagtcattaggaatgtgtcactctgtaattggcctgcgtttctgggacccgtcagtatctgcctttttggatcaatgtgtgatttttgaggctgtgacagtcccgctctgagtgggttgcaggtgaagcacagttgccctgtcttacgaaagggagagggttggcaagaaaagtccatctgacattgtaaacagctaaatttatcaaggcaacccatttttcagctatacagaactgtatttctgtagctgttttttaaaaatattatctaataacctcctagatttttctcacttcctacctatggtgaaacatgtaaataaggagaacccaaaagcatctcagttcataacacgtttgatttttttgtttcttttctttggaaatgttcttgcatgaaccatttgcacaatgccaggataaagccagttcaaacagatgtgaattgctgacttgatcatgagaaaattagaaaaaagttacctaatgctagtgtaaaactggttagtgtgtgagggtgtgcttaaagaagcaggaaaattacacaagacgatatgagtaccccaccttggaatcttaacaggggaaaaagtctactcattaacatatgctttaaataatccaaaagattaaataataccatgataaaataacttacaattgcaaaaatgtatttttaaagtacaaaaataccagagaaaacatttttattgatctacgtaagccctattaaataaattattttgcagagacattatgcagtcattgggaaaatgggtttaaacttcagtcagactcagattcaagtcttagctctactgcactcttgttctatttcctaagcaacttaccaaaccttttggagtctcagtgttcttatctgtaaagtgctgataatataaatatctagcccacagagcggttgtgaggaacaaaggagaacacacataaagtacctgggttatagaaagtatgcaatgtatttgcgtcagtactgcttctaatagtactcagtgccactctccaaattccacaatatgcttaacactcaaacttatttgatgagaagatctatattttttctactataccacacctgtacttcacaatatttacattgtttaaaaaagcaaatgttggtctcattgatatttctatggctaactcatcatggaaatgttgaccatataaccttgtaatgtcttattaagaggaagtgggctttccaagggcaaatcaaagttttctgaaatacgaatgtattatgggtctctgaagcacatgggcattagggaaaacttcatcccaagatcctgaaatggattaggatcaatttgtgttaatcttgaagtaattgtctagcccagggaagttcctgttaagaactcacttaatgattgtggaagaaaagaaagaaaataaaagaaggaaagagggaaggaaggaaggaaggaaggaaggaagcaagggaggcagggagggagggagacagggagggagggaaggaaagaaggaaggaaggaagaagggatggagggaggaagtatcaataaattaattactagttataacacctgaggatcatcttcttgcgcaaattatttttaacgttctttagctacaggcaaagatcatcctcatcccaccacttttgtccaaaattgtagctgcatccttgttttattgtcaagctagccttaagacctcgttcctcccttctaaactattggccaattctttttttttatacttgaaaatgtgccctttatctaatacttattatagcaaatcatgtcgatctctaatggctctgagcagatgcgccctacttggtgcacttgttccactccttgatgcagagagactgtctctcttattttagccttttgcatttaatgctttatatttgccttctctcccacccctatggtccatggccccagtaagaaggcaatatccatgaattattcttctccagaacacaatactgcacaaataaacattttctgattttcaaaacatttgtgcatatatggatgatctgtgtgtgtgtgtgtgtgtgtgtgcattcaaagcacacagcatgatttctaacatacactatgagtgcataacttggtctatgcattgactcagatacaaaataataattcaggaaaaagaaaggtattcaagatgaagcaagataagccatcacactttgaccatcctcaagaagaaattcaacagggtaagtacaattagggatatggtatttcacgtgtggtggtccagcaggatgcagcccatgtgaacttactttcagcgcttgacagacattgtgagtgaaaattattttgatcaaagtcttaagttagatcgcacactaaatatggattcatctaggttacatggtagactgagaaatccattgaaaatttccgcccgagaaaaccagcttgaaaataatgtaagtcttgtcactcgaggagacttggacatattaaaagagtttgatgtggaagtttggaaagcacctataccaaactgaaatattgccaagattattaatgcatcactttgatgagccaagaatttccatctttccccatgggagggatgtctccaatagttggaggtggaaagagggcacagcttttattttaagaataaagaatttcaaaatgaagaaaagaattgcagctaggttttgacagagcctgttgagaagtggaggcaaacatgatgttttataaatgttggtattacaatcagatcacttttggtaggtgccttctgattgtctaattagtatgatgtcagctgggcttgagaatcatttcttttttttaaaaccatctgttttgtcataaaagtttctttagaagccatatgcaggcagagcatttatgcttttgttttttcaaagtgatcttctgtgttctttgtgtctacatcctgtggcataaatcgtagttttaaactatctaggaagaatgcaaggagtccagcagaagaaataaataaataattggccaattaaatcaattaattgaaaaatcagtgatcttggacacaagggaacacgtcacctttaactcgtgtcacaggaagaaattatgttttcaaaatggtgaggttttgaatcatattgccttctgagcctgaattttcctatttaaaaatgggagatttggtaaggaattaattaaactcacatataagaggacaatgcaggagaaactctatattataataaattatatattatagatgaagatattttataaagtcttaaatacaaaacaaatatcagttataacaattgtatatattttaatcattataataaacatttattaaccactagaaagcaagctagtatgagtcattaaaccacaattttctaccatttgttacttcaaaacttcttcccttgtcggtttcttgtacatgtttgctgaatgtgtacatacatgcatgcatacctcgtctttctcaagctagtgaggttaatgactataaaataacattttattttccctttactttaaacttttcccagcataaatctgtcagtcaagtactcctgcctctcgcttgatcagaattacatggttgttcttgagtccttttgagatcccaagagtctggtgacatatttgtaagtcacaaggaattaagaggtcaagaacatcaatatcagttcaggaatgtacggatagagccctatgatcaagcaagaaacaccagctgtaagcaccattcaacgtacttagaacagttcaataaactctgatggatgatgaaaatttcaaaagcatactctacacaaggaacataaagcaatctttttggatagtcaatttcttggtagtaatagtagtagcgttaatgttatttctttacatttgttgagcacttgatgcttttctaagtgctttaaaacatgttatctcagaatgtttagtccccaccagtgcatcccaatttgcagatattaactttgagctatggcagcaaacagctcaagatctacattagctttcggtgtctaagaaatgcaaaacttcctcattcttcttaccatgtaattttccaacatatagggatatattagaagcctggagactcagcaacttgccatctcttacaaaattaatgatggagttagtatttgaacctgagtcttctgatcttttcaccagcatgggtgctgttcaggctcacactttggatcaccctgtgaggctgatgctggctgtctgtgaagcagcaggaggaagagaaacaacccacagcacagaaaacagtgctgctttgaagagtgggtcacaacacgattgccaggctgtgatgcatctcatcttgtaaaagtaaatacttggcgatttccttgtggattccaatagtttctcttgtcacacactgactataacagctgcattcgcttcatgaaaatgggttagagataataaattgaccgaaaatatagaagactgaagtttttgaaagcagtatctggaaacaaattgtttataaattttacctctagaattttgaactccagagcaactcaatttaaaatttggaacaacgataattaccaaagaattttccacagccttaaactagtatttcccaccaaaacagtgatacttaaaatgcatatgaagtaatttattttaggagtattgtgcatattatgcatacacacaaacttacactactatgtaactgagaaacaagaacttgacaaggtgcaggtcaggctaggggtgagaagttggagtgaggcagatacagtgcgactggaagggaacgcagtccagaacagaatcaggtgttgaaactatcaggaagcagtgaattccaactggcacaagtgttgttgttgttttttctcatctccgacttgaaaactgaagggacacacgagtcctttgatgattccttgagtgatccagatgtactgagctggggatgttttggaagagggaattttctgagtaaataataagggacaatatctttgtatcagatgtacataaatgtgataaacatgctttgaaagtgctgtagtcaaattcttaaattatgataaccgagaaaaaagttaagaaaaatggtatatgtataataatactatgttcagactccactgtttctgccattttttttgttgttattttatctattttttcttggtctccttcctttcttctccttcctttcttaacccttccttccttcttttgtctttctctctctctctcgctcactctcttcctctttttctttcttactggcagtctgagtggtaagacagtgctgtatatacagaactgtatcatagaagggaacctagaaattttctagttcagagttttctaaaatgcattttataataaattagttgtatgagatatttttagggggttctatgctaacaaactgaaagaaacatggtgttttatattcctccttagaccttcaccatatatattggcaaattaaagatgaaacattttgcaattaagataactacttaattttgttttatctatttatttccaaacttacactcaatgaccctaacttggataataccaaaagaacttaaggagctagctaccccaaatcactgttgggggaacagacgatttattctatcttgctactcactgcaggaataacatgtcagcactaatgacacatatttgtgaatatgtgttttgggtactgtcaggggctctgagcaataatgaaggaagaaccattcaacaggcacccttttatgggtcagattcgttcctttagtgggctcttttagagggttttattgttaatttcctaccaacacacttgctacaatatattgtataagaaattcataagttcctgggctaaggcatttggcctaactgtctaagccgggatgctgtctgacagatttttcacaaatttatcacactgagtcattgtaagggaattaggaccacaagagaccttctttttggtcctggttaggatctgaacatcagatttctgtttaggcacccagaactggttaatcaaatcataatgactgtattccatactgttattcatcggggaagcatatttatctgagtatcagataagctaccttttaattttttttaactgctatgatgtgccacttaaacgaatgccaagactttgtgcttacaaaccttctacccacaaagaatcctttatcttacctttgcataattgacttatttctaattaaatgtggtatagaaaaaaaaagacctacaaaatttcaacttctatcatttgttccttcctttaagtctctgtgcttctgtaaacatgttagaaccttgagcaatgcattgtccatgctgctagctcttcctttcagataggtttcatgatacattccaccaaccacaacacacacacactcacacacaaacacacaccatccagatctttattctatttcccgattaaatgttcagaaaggcagtgcaaggccaacatctaagtgtgcaactcaagacttctgtccaccttgatattattcagcatttttgagggacagttggtagttacactaactataaatctaccagactatatcatactccttcatcttgcccacaaggatatcatatgctctgctaaaaatcaagaaacactctatctaattcttccagtttaccaatttaataacactaccaaaggaggaacttgtactagtttggctcgtcttattattccaatccatgagagaaatttgtaataaatcttcattgttttatgtcatgacactcccggtattatttatgcaattctgttttcactgccaatgtttcatatcaagtaaaaatgttttcatatcaaataagcatatttgaccactatcaggctattggcatctctttatcttctgaaattttgcaaatattacctcataattattctgaatgctatttgcagcttgtccatttgtaaagaatttgtcattcaaaatattttaaaattttcatgtttgagaattaattcaactcataattcaattttatagttgtttaaaatcttctttgtaaaagaatatgctcagaatattacatcaagaaggcaggttggacacatacacctatcttgtgcctatctcacacaaatcactgaataatagaaatcatgcaaaaagtaaaaataaattgataatagtgttcacaaacaattagggggcagcaatcatcagacagaaaatcctgaaaatgtgttgcatatggaattagtttgctggagaaacaagagtaagccttcatttacatatggaaaaaaactatagaaaagggaaagtcaggttctgtaatatttgaattttgtgatcaacagatacaagacaagccctctggactggtgcttctcaaatgtcagcgacacacaaatcacatgggaaaggtgtttaaatacagtctgattagaaggtctggggtggtggccaagtgtctgctttgcatgttagacaatgctaacactgctggtccttaaacatttctttgaatatcaagggtcttgatcagaggctgtggggggcagagcccagcaatctgtttgttaacaagtcctccagggcattcagatacatgcttaaatgtggaccctctagtagttaagtgaacaggtgcattgagttcagctggcctgttacctacatttaccacatttccattccctcccctaatccaagctgcagggtccacaagtgttttctctgaggcttaaaaccctgtataactctggtctcagaagatattaatcaatgaccctgaggagggcttacagtgttgattcgttatctgaggtagaacaaagcaaatttggagattacctttatccttttaccatctacatgaaggaggaacaaagaaaaggcagttttgctgagggagaaaatctatccaagtgatccacccatgttaaagtgttttttattttggcatttgcctgacagggtctgaagcttgcctgccactttcccattcacgtttcttagaattagaatttatatggagcctatgtctactttcatacaatatatgaaaacacttaagttatcatttaaggtaaaaactattgattaaaatatgtttatcctcttatcttgataatgatgtgatggccaggtttatatttagaattttgtgctgcctggagttccacatttgaatgtggagctgtagggacagctccaacctggcctttaagctttcctcccctgatcaaccacccactccctttcttttcttttttttatcaatctacagcatttggactcaacattttgcaagtaagcatatcttagggatttgtgacaatcttttcagcaatagtagctcattagagtggcaatgctaaatgctgcctgtgggtggttagggcaacagaaggcatacctccccaaaatgacatattataatctccagggagacgtgtgaaatttgaaaaagcttccaagatgattgcctagttaccattttgggatttgaaatctttatatacgttatttccatgccctccttggttaagtctccagatggagtaattatttacaaatgtcaataatatttacttcaaatcttactatattaacaaaaatcataggcaacgttaaagcctcttgaacaaattctttcttccttatataaatcttgtgagtctccatcctggacaagtacttgtatatttttttcacatgtggggctgacactcagctgatatacaccacaaaaacttatttgttaaacaacattatgctttataaatctaaccatttagaaatgatacatgtatatcaagtttattatttttgaatattttattccagacacccaatcaaaaagaaatataaatttgaggttgggcgtggtggctcacgcctttaatcccagcactttgggaggctgaggcaggtggatcacttgatgtcaggggttcaagaccagcctgaccaacatgttgaaaccctgtctctactaaaaatgcaaaaattagccaggcgtggtggtgcacatctttaatcccagctacttgggaggctgaagcaggagaactgcatgaacccaggaggcggaggttgcagtgagctgagatcgcaccactgcactccagcctgggtgacagagtaagactccatctcaaaaaaaaaaaataaaataaaataaatatatatatatatatatatgtatatatatttgatatattaaaaaataaactatattaagaaaaacaaaatgaatacttttgtactcaatttcatcatataattatttgcatattaacttgagggtctttttataaagtaaaacaacagaaacaacgaagagctttttgaaaatttcccttttgttgcattccttctcgaggtagcaattatattaaattcaacatttcacagtgtatggatttttttctaatgccaccactggctggttttgagatttttctcattacccttgatatttttcaatttcattttaaagtacctagttgtgggctgagatttttctttttctttcttttttgagacagggtcttgctctctttcccaggctggagtgtagtggcacaaacaacctgggcaacagagccagacttcaacctcagcctcccagctcaagcaaccctcctgcctcaggaggcaagaagctggtacctcccaagaagctggtaccactgatgtctgccatcactcctggttaattgtttgtttttgtttttgtagagacagggacttactctgttgcccaggctgctctcaaactcctggcctcaggtgatcctcctgcctccacctcccaaagtgctgggattacaggtgtgagccactgttcccaggcctgatttattttattttaaaattacatgttttgagccaggcatggtggctcatgcctgtaattccagcactttgggaggctgaggtgtgtggatcacctgtggtcaggagtttgagacaagcctgaccaacatggtgaaacatcatctctactaaaaaaaaaaaaaaaaaaaaaaaaaattagccaggtgtggtggcgcatgcctgtaatcccagctactcaggaggctgaggcaagagaattgcttgaacctaggaggcagaggttacagtgagccaggatcacgccactgcactccatcctgggcaacacagtagactctgtctcaaaatttaaaaaataaataaatacataagataaaattacatgtttgggtactgttagtgtgttttttgattgaagaactcatatccgtttttaatcttacgaatactctgctatttttttcaaatattgctcatctgctattttttccgtttatttttgtgggattactgtgaagcatatgctatatcctctccttctgtcctaagtgttttgtatgatatatccctttgtccctctgactatggttataggtgagtttcccaggaccatttttctcttttcttttttctttccaacatgtattttaggtgcaggaggtacaggtgcagatttgttacatgagtaaattatgtgttgtgggagtttggtgtacagattactttgtcacccaagtaataagcatagtacccaataggtggttttgtgatcctcactctcctctcacttgccatcctcaagtaggccctggtgtctgtggctcccttctttgtgtccatgtgtattcaatgtttcactcccggtaccacctttcgatttacaaatttgtttttaaattgtatccagttatgatcatcccatctgatgcactttttaatttatattacaattacttaatactatatgtatactttttatttctatgatttgtttatgattctttttcataagacaagaaagttgctttggttgtttttgttttaaattaatattgaattcatcttattgagcactttaaacatcttccaaaatgtttgtcaatactagagttttattgacttttataagatacattttcttcctgtgtttgaaacatttgattccagtctcatttgatgagagtatattttatatttttctccttctgtctctctccctgcttacttttcttggtgctcatatatctttgtattgctgttggcaattgcctctcgtaacccctgagcagccactttataactgggttttatacggtagtgattctggggagggcagatcccttcccagaaccagcagaagtctgtcctcaactcatgaagtccccctccatgtcctctcttctccctatacctttaggttatttagagcggctctgtccaatcaggcagccactagccattgatgaatatgtaagttgaatatttagtcaacggaattaaataaaatgtaaaatgcagttttctattcacactagccaattgtgtctaatggctaccaggaagggcagctctcatgcatcttgacagacagttctatcggatggtgtgactctagagctataatcccaggtgtcgtttctttcttgttgttgttgttttttgtttgttccagcagctggtttttttttgtttttgttttttgtttgtttgtttgtttgtttttgagatggactctttctctgtcaccaggctggagtgctgtggcgcgatcttggctcactgcaacctcggcttcctgggttcaagcgattctcctgtctcagcctcctgagtagctgggactacaagtgtgcgccaccatccccagctgatttttgtatgttagtagagacggggtttaaccatgttgaccaggatggtctggatctcttgacctcatgatccccccgcctcggcctcccaaagtgctggaaccagcggctgtttaagcttggcttgttttctttgggatggatgagccacataccatgtcccactagttgcaagcagaaagccttactttatttccctgtttcattgaatcactttcagccctctgtttcttgcaggtcctaaataaagtccaagttcccattgtctgggtccagggcttttaaatccatggtaacaaaataactcactgctttgtttttctgttccttttctggtcttcaaatcagaagctgctgttatagttttcctttatattttaaccattgtaaataattatttggacccaagagattgctgaagaattgtgcatcttggccaagaagtaaatagtccattcacttttattgcagacttatattccattatattttgaacaacctatatttatttacacatactgattttatggccattttggctgcttccaatttttacaattaataagaatgctgccattaacatcttgcacttctgcacaagtatgcaagttcctttgttggacatatagcaagaaatggagctgccagatcataggatatgtgcacactaatcattgttttatattattcttcagaattgttgcagtgtttaatcactattcctcagtatttctcaagattaagaattgatttctggctgggctcagtggctcacacatgtaatcacagcactttgggaggccaaggcaggtgaatcctctcaggtcgggagttcgagactagcctgcccaacatggtaaaaccaagtctctaccaaaattacaaaaattagccaggcgtggtggcgcatgcctgtaatcccagctacttgggaggctgaggcaggagaattgcttgaacctaggaggaggaggttgcagtgagccgagatcgcacgactgcactccagcctgggcgacaagagcaagactccatctcaaaaaaaaaaaaaaaaaaaaaaaagaatttatttctgcaaatggtggatgtagaatgctatctgattttaatttcatttattcaattattagctcatatctttttcattttttatttttattttattttattttatttttattttatgacacaaatgggtcatttgtgtttcttccttggctgtttacctgttaatggcctttgcttatgatttttttactggtttttacaagttatacattcataaaagtaaaaacattttgtttatatgatttgcaatgatctttttactgccttgggctttcttttgaacttcggtgacttttgtttagaagtgttttgtgtttttattgagaagtcaaatacattatttacttatgttgctatgtttcacaggctgctctctaattattggcctcaattgatcctcttgcctcagtctcccaagttggtgggattacagtcctgagctattttgctcagcagattgattaattgattaattaattagagacagggtctcactctgtcacccaggctagaatgtggtcaccttatcatagctcactgcagcctcaaacttctgggctcaagtgatcttcctgccttagcctcctgagtagctaggactacaagtgtgtgcaaccatgtctggctattttattttttatttttatttttttagagatggagccctgccatgttgcccaggctggtctcaaattcctggcctcaagttttcctctcacctttgcctcctaaagtgctgggagtacatgcatgagccactatgcctggccatatttattcttaaataagaatgtttctgatttgtgtgttattcaatgtattattctctagcttaaatttttaaaaatatattcctcctatgtttaagttgtgtttttcatatttaagtatgtaatatatctggatttatctgtgtgtttgtgtgtgtgtgtgtgtgtgtgtgtgtgtgtgtgagatggtgcataatttaattatttggtccatatttatgattggtggtcctatgatcctttgtgtatgggttttcctttcccctctgacttcttccaatgctacttaagtattatactaattcccacatatgacgatttgatttcctctgttctctactattggtctgtttatcatatgatcaattttacaccatctttactgccattctttatgtcttatagggaaaatcctcttggatccccattgtgtatgtctgtaaagttttatttactttcacagcactctcatacttttgtattctaacttgtttttggatcacacacacctgcagacacatagacacacacatggaaattgcatttaatttgtaaataaatttgaaataaatgacattttacaatgcttttctttctattcaagaaaatgatatgcctccatatttctccatttatagaaatcttcttttagagctccttcatgaaattttataattctctccaaaagaatcctttgcaccattagttagtttcatttcacagtagttgtaactttggttgccattttgaatgggatttttaaaaaatattttcttctaaatatatgttattggaatagaggaaaaatagggattttatatattctataaagcaagattaataaagttcactattaaagagttttttaaaagattatactaaggttaaaaaataacaaaccatatctttcattattctgctggctaaaaatcaccaattaactgtctaattgaagtattgggagcagtatccttgatttgtttccgacgtgaaagggaaagcttgaaatattttcacattatgtaatagttacatagggctgtgaatctcaaaccttcgggtgcatcagaaacacgtggagggcttggttagcaaaaggttatgattctccatggccaacgcttccgaaggagtaaatctgagctgggtgcagataatttgtattccataacaagttctcaggagacgctgctgctggggatcagaaaagaaatgtggtgaagtgggcagagaggctggatgctcgcaatgggagtcagatggcaaagttaaagatgctggtcagggcagggctcactggagcctaagttgtcacctgagcaaggtcttgaggacatgagagcattaggcatgaagattcctggaggaggagcttcttaggcacgtggaacatgagaatattactgatgtgtctgagaaacttcaagagggccatagtggctggagtagtgtggttgataaagaattataaaagagtaatcccagcattttggaaggccaagacagacggatcagttgaggtcaggagtttatgaccaccccagccagcatgatgaaacttcatttctactaaaaatacaaaaattagccaggcatggtggcagatgcctataatcctagctactcgggaggctgaggcaggagaatcacttgaatcggggaggtggaggttgcagtgagccaagatcgtgccactgcattccagcctgggtgacagaatgagacttcatctcaaaaaaaaaaaaaaaaaaaaaaaaaaaatcataaaagacaggcaagagggctaatgggaggccaggaggactaccttaaaggatcatcgtaagcactctgtcttccattttaaatgacttggggatttgctctcaagagtaagataatttgatatgtttttaaaggatcatctgacttttaagagtaagcattaaagggccaggatagaaacatggagaccaagaaaggggttgttgcagtaatacagacaagatttgttgtcatggtggggagaagtgatcagatttcagtatggttaaaggtagaccttgaacttgactctcctaccattggataagggatgtgaaataaagaaaggagtcatggatgcttttggcctgagcaactcaaaaaagattgaaccccttcaaggaaactgagggtttcccttaaatgaggacactgcgtaaagaaaggaaactgttctcctaatgcactgggtgtggaaagtgctgaggatattccaaataatacaaatacagaggatttatcaagtgcatacatgggacttggtattttttatgaaagatttatttaaggactagggaccactgtggacctccttgtgaaaaacataaattgtattttgatatcgtctaatgttaaacccaagtttcttcacaatgctacctctctccctcaattatggaaacctatatgaccacactgaagtttgccatggattcaatttgtttattattctacctcttgattcttgctgccacaaaacagtagtcatttcaactctcatcattttttcctgaagatgtggatggatgccctgctgtcccagagacagacctgaaggagccgccatggttgtcatggtatgctgaatgtacaccatagggctcagtttccctgaggaattaaagtcattccatagtaatatgtatcacctttaacttatgataacaatccagtccagttaatttcatttactttttcattgacagttaaaatgatatgtattactatgtacaatctgatgttttgacatatacatgcaatatgctgtgactaaatctacataattaacatatgtatttcttcatgtagttatcatgttggtgctgagaacactttatatccactctcttaggatttatcaagaatacaatatattaactatactcaccatgttaaaaaaaaatgtggatggatgctccctcaacaaactgaactttcctttccacagtaagatgcctgctgtgagcagctgcagaaagcagctctgtttcagcaacaaagaaaagcatattgcagaactacccatacctcatgcttccgtgtcattttcctttgcatttatttttattattcctcaaaaaacagaaacaatgttttctgcttctgatgatcaaatatttatcttctataaacttgtactttatgcttttcagtttaactacaattacctttggttttccctgggtataaaatggatgataccttaatttaaaaatgaagttttcacacaagataagaaaattgcaaattctaaataaggattgatgtctgttgctaatagtctaacaagaaaaacatagtggtatatcagaggaaatatttttttaattagcaatgtatatagttctcatttaatgactaacttttaactatgtttgaatgaatttttccttgcccacctcatcagtggcacaccgccatgacacagagaaaagtccacatctattgattattaaaaagaaggtagtgaaaaatctattaactatgttttatattatttctgtgtattcttaaacacaaaaatgaaaaataaaaatcactccttttactacaaatgcttaatctttattttctaaataataaataggctagagatgttcatttcctatttccacccaccatcatcagcactatttagtttttaaatagactaaattttttttagtcaatctcaagaaaaaaagagtttaaagtcttgggtgtggctgggcgtggtggctcatacctgtaatcccagcaatttgggagactgcagtaggtggatcgcttgaggccaggagttcgagaccagcctgagcaacatggcaaaaccccatcgctaccaaaaaatacaaaacaattagccagctgtgatggcacacgcctgtagtcccaaccgctttggaggctgaggcacgtgagtcccttgaacccggaggcagaggttgcagtgagctgagatctcgccactgcactccaacctgggtgacaaagtcttggatgtgaatctcaactactttcagtggtgtctctgacaagttgtcatccctcctctgctggagtcctacagtgacagcaattgcactttattctagaacggtacattttattttgtggtttctatgattttcaaatacatatttacattctttgaacatcagtttctttaataaataggaaccaaaatgaaaatgttatagtgatgagacataaggtaatatatataaaatgtgtatcagtgctatcaggattgcaaatattctgtaaatattagttattattttaaacgaatttgtgtcaaatctttgccttgaagtgatacagtgtcactggaaggttaagatatgaacatactttgttagttcaaagtatcatagaccagtgtcttataaacaacagatttttttctcacagttctggaggctggaggttgaatttcaggtcaccatcatggttgtacctgttgaggggcctcctccaggctgcagactaccaacttctccttgtatcctcacatggcaaaaagacagggggctagctctctagcctcttcttataagtggataaatcacatttatgagggccctgtcctggtgacctaattgccttccaaaggccacacctccaaataccatcacactgaaaaatagagtttcaacatataaactttggaagaagacaaacattcattccataatacacacagaaaatgaacttgagattattttgatataaatgcgattctgtagaaataattttaaaaacccgagtgattgacagaataattaattatatagaaaacaacgacacgaagacctaaaggtatgtagagaatattttcagttttaatattcaggtaagttttttaattgggttgggttaagcatatacatatgtatacacacgtataacatacacatatctcatctatatagacacttccccgtgaacctagttgttttgcccccacacccaatccccacccactcacatatctaaatgtatctctgaatgcagatctgttaaggcaggtgggaaccttagagtgaatatagatcacttgtagccttctccacaaagcattagcactgagactcagcgtgcacacatttctacatggcaggtggccccatcgaggtcctgttaaaaagggtgcagatatagaggatgtacggtgccctgctgataagaactaaacagtgacccctgataaattaacgtttctttgtccaaaccaaaatgaggccctgactcatttcaggagaggcacttataattattgaggaaaggtgttaggaagaaatcacaggccctagagactctcaacaatctgtatcaataaagtctaataacatcataggaagcaaattaaggtggaaactgattgctgctgattgcaaaggtctttatacataatttaaatgatccataaagagcaactggtggactagtctccaaaataaattatcctgtaacaggaaattcaaatgttttgatcactagaatacaaatgataaaattacataatatgaaaacataattttaatatacattttactgaggaaagtggtttctatttaatcagtgaaaataagtttattaatatggaattgtatagtctttcattggaactagttatttactagttcttttattggttaatgtgagctaaacatcaaaccaaattctgtaccacttattcccaaagacaccgaatgatagagtggcagtaatcaaaataaagaaaaaaatacaataccttaaagatgtaggtgcattgaaattaagtaagctttacatctagaaacaattttggtctatctgaggcttgattctgagccctgagcttgtattatataaataattttttatagtgaaaagtgatcatgactttggaatactatgtaagcaatgttttgggcattatctgtttctctagtgggtccatccatccaggttcattggtttgcagaaaatatataaaatgaagcattggaaaagctttttttttttttttttttttttttttgagatggagtcttgctgtgtcgcccaggctagagtgcagtggcttgatcttggctcactgcaagctctgcctcccaggttcacgccatcctcctgcctcagcctcccaagtagctgggactacaggcacccgccaccacgcttggttaattttttgtatttttagtagagacagggtttcaccacgttagtagtagatcggggtcttgatctcctgacctcgtgatccgcctgcctcgacctcccaaagtgctgggattacaggcgtgagccaccacctgtggccggaaaagctttcacataatctccaagcacagcaggttttaagtaatctgagtgtacaggaatctctcaaccaaggggttcttgggcttctactgtaacactcccagtggcagagaccattgtgtttctgtatggttctattgaaaagtctttttttttttttaatagtgagccaatgtctctgtccttccatttccactcacctgtatgtcaaagcctcacaaaacaagcccaaactcagtgtcccaagacagctatcagctgtgggataataaccaccacaccctcttcccgaaaaggagactgactccagttattctattcactaacatattcctctgagtaattcattttcaatgtctctgttaaaggaagacatttaaaaaaataaaaataaagaggacgagatccacatatactagtctgctagctcctatctggtacacccactggctttaccctaatttcttcaactcaaatatctccctttctcccttcagcctaggagtgagatggtttcattctgttgtcaactcctgttttactttatcatcccttgcttagcttctgactctttcttcacctgtgcaatcaattgtctttattaaaagatacttgaagaggtttctgttgtggtttccgtataccaagaacacgatgatcatatttgtgattctgattacctattctttgaggttcaatgtctacttcttgtttaaagcaactgttagtattgacattaaaagttctactatataaattgacatctgtggacaaaagaaaagtgatttaaaagtttttcaatttttgacaatgaaaactcatggtcaaaaaggcctagacacaagtcacaactgcaaaccttatttgctttgcaacttgctcaaattattccaaatctccattttccatatttaaaataacaaaacaatgctgacttaacaacacagggtggaatatgtaggtaattatgtcaagtgtctagcacagaatctggaaaattgtaggcacttgataaacatgacttctgccgtttctacataaaatgatgtagattaattccaagagccccagtcacttcttatttacttctgacaaatgatttttttctaaagtactaattataaaattgactaatgatgttgtagcctagggaagttttagagtaggtcattaaagttgtaattgtagtgcaaatttttttagatcgaggtctggtaataaatcccccagaaacctttatataatgtagctttctttatttaaaaccaaggcacagaatgaaaaaactagagctttgtatcttcaaaaacgtttatgagctttataagtaatgagtaggcatggctctcttttgtgcaccagaccagggccattagaggaaatgagtgcccagaggggataaatcactctccccaaagtgcagtgaggaagtagtgaatgggagtgtgtatacctgtgcacatgcagttgtgtgagagtgagagtgtttgtggtggaggtgtgtgtattggaagtaatagtgtagattccaaaagaagatggatgcagaggtttgctattctagttttgataaatttaagacctctattatgtggaatgattaggggaaaaaccttttgctgttagtgttacaaaaacatgcatgagtgtttatgttctatagataaagatacataccttaatgtatgctatatagaatatatggtcaagccagctgatctgtaaacctgtgtgctcttagatccatgtcctggcccttcttctattctgttccctatttcagagcaccacatttcttaggctctcttgaccaacggctttgaggggagttggccagtaggaagcactaaatgtgaaggctctctatctttctgttttgtctgtttttctggttcacttccaacagcagctaggttcatctagggtttcagctcctgtctgatagacccattggttttactttagtctctgtgactcagacgtctccctttctcccttcagcctagggatgagaatggcttcatgctgttgccagtccctgttactttatcatcccctgcttagcttcttgccacttcttcagctgtgtagtcaattgcctttattaaattttctcatttcagatacttaaagaggtttctgttttctgggtataccaactcttgctttctcagtatatttaatattgagtgagcatatgaattgagagattaggatattagtacatattaaatctaaatctatattaaatatcactgtaattttcctttagacattttcagattgacttaactgtgccattaagtgactgtgggaaatcattaaactcgtggtcttactttaacctttatctgtacaataagtctaaaatgataggcttgacttacctcaaaagatagttaaggctgggcacagtggctcatgcctgtaatcctagcacttcgggaggccgaggtgggctgatcacctgaggtcaggggttcaagaccagcctggccaacatggcaaaaccccatctctactaaaaatacaaaaattagttgggtgtggtggcgcattcctgtaatctcagctacttgggaggctgaggcaggagaatcccttgaacccgggaggcagaggttgcagtgagctgagattgcgccactgcactccagcctgggtgactggtctcaaaaaaaaaacaaaactaacaaattaataataaaatggagcacttgagaaatatgcataacactgtgtaagtgctcaagagcaacaagagaaagagaaataaacataagtctccattgttggtttaatgttgaaatcaaatctaagctttaacatatgcttttcatgtgccctagaacaccgaggttgattcaacttcaatctctaaacctacaaaatagtggtaacaacatctccttctcaacagtgtcatgagggttactttacctaacctttgtaatgctctcagcacatggggattgcatagaatgggtcttcaaggaggttggttctttcttcatctattcctcagcaagatgtagaagttctttctgatagcactccctggtcaatttattcctaagtaaaacacatatataggagtattttatacatatatatatatatatatatatatatatatatcacccatcacttgattaactgaatctctctctctcttttagcagaaactaatcaccatgtatttattgagttcaagtcactgctcatctctgagattccatttcaacttgtcaaacactccagttaaatagtattcctctgaatttcactttgaatttactgtatatggatatctatttaatttttgccaacttacttgttccaggttgcattttgcttttttatttttatttatttgtttttgtttgtttgtttatttattttgaaacagagtttcacccttttttttttttttttttttttttttgagatggagtctccctctgtcacccaggctggagtgcagtagcgtgatctccgctcactgcaagctccacctcccaggttcacgccattcgtctgcctcagcctcccgagtagctgggactacaggtgccctccaccatgcccggctaattttttgtattttttttttttagtagaggcggtgtttcactatggtagccaggattgtctcgatcttctgacctcgtgatccgcctgcttcggcctcccaaaatgctgggattacaggcgtgagccaccgcgcccggccttgaaacagagtttcactcttgtcgcccaggctggagtgcaatggcacgatcttggctcactgcaacctccacctcccgggttctgtcaattctcctgcctcagcctttcgagtagctaggattacaggcaccctccgccacacctggctaatttttgtatttttagcagaggcgtggtttcacggtgttggtcaggctcgtctggaactcctgacctcaggtgatctgcccatctcagcctcccaaaatgctgggattacaggcgtgagctaccacacccagttcttatttgttttaataaaaggtcaacaattttatgcatatcactatttgagagaatatcccctacgttgccttctgtagcttacctatccttacacatgtgtttgtgtaatttgcccagtttccacatgacattcagatttagaatggtatgtctcattatgcaatcttgcccaagctagtgactttgatattgccacctctttttgaccttgctttgttacaagaaaaaaaaaaaaaaaatgggaggggacatgttacccaaactctagccagttgaattgtgctgactgctttccaaaagaacatatgttctcactggaaagattcagaaaaatttggcatcagggatggcatgtggaatttaggaataagtctttgctttttaagaggaagtatgaaatagaagaaagtacattgaatttagaaacagaacatgtggggcctggttgttgttcgaccccttatgccctttgatgtcttaggtaagtccctcatctttgttgaaacatgctctttattatttcttctatctccacaattccatggtattagaaaatgtttatatttgagacaaaacctgcacttgcatctatctgctttaatttgaatattatatttttgtgtctaagatacgctataatattgagcgattcttggtattgaaaatcaaaggaagatgagacattataaatgggtcatagtcaacaaagcaaagaatgtgcaacatttattaaaactatttgatccatcttatattgcatcatcattaagtgtattttttagttttaaaaatgcaaaaaaatatagatgtggtcataatgaaaagcaatcagttatggacctatttttctgctccaagcccccacccctaatctcctcattcacaccctgagctcaacacacacaggatagcttattaaatcacttcacttggggtttttctggttgttaatttcacatatataaatagcacactaagcctctatttcttgctttatctactttagatatggagcattgattttctactgataatgagaatgaaagtcatttactccgcaccccacttcttctgtctcctccctgactttatcattattctcagtttccaaagttggtcttcatgacacacctaattgaggataatagtatagttaagaaacagggcttactgtggaaagcagtttggagatttctcaaaggacttaaaactactgttcaacccacccgtcccactactagtatatatatatatttaagagaaaataaattgttctaccaaaagacccatgcacttgcatgtttatcacagcactattcacaacagcaaagacgtggaatcaacctaggtgctgatcaacagtggattggataagaaaaatgaggtaatatacatcatggaatactacacagccataaaaagaataaaattacatctttcacaaaacatggatgcagctagaggccattatcctaagcaaattagtataaaaacagaaaaacaaatattgcatgctctcacccatgaaaactgaacaatgggtttacatggacataaaaatggcaacaatagacactggggactactggagaggggaaggatggagaggggcaagggttgaaaaactaactattggatactatgcttcgtacctgggtaatggggtcgattgaaccccagaatctcagcatcatgcaaaatacccatgttacaaacgtgcatatgtacaccctgaatctaaaataaaagtttaaattatgagaaaacaaacagaaaatatatttgaaaaatatttgtatcattaacgtaaattcatgttgaaatgataaaacattttgccaataaaagtaattttaacttggaaaaaaaaatagaatgatagtctataaatgtgtgataattcctgaagcctttggaaaatacgataaattttaaaaataagatttaatgatttgtctttaaaaacataaatagtccaggcgtggtggctcacgcctgtaatcccagcactttgggaggccgaggtgggcagatcacttcaggtcaggagttcgagaccaaactggccaacatggtgaaaccccatctctaccaaaaatacaaaaattagccaggcatggtggcacacacctgtaatcccagctacttgggaggttgagacaggagaatcacttgaacctgggaggtggaggttgcagagagctgagatcacgccactgcactccagcctgggcgacagagcgagactccatctcaaaaaaaagtaaataaataaaaaaaatttaaaaaataaaagcataaatgaatgaattgatgaataagtaaatagcttagcttcagaaaaaaaaagaaaaaaaaacaagaaacaggaatttttgtataaaattaagattgctctagttatataattccctggttttcccccaacaaattttcaaacttacaataacaattatatttgactgagtgccaatttaaacctataggcctatgctactttttttttttttaagaccagacctccctttcatctcagtctgaggtacatgaggcttttaatatgaaatcactttccattcggtccaaagcttccttgttgctgatgaatgtcatacataatgaaagattatatccatttatcctcagcagtaaatcatttatcacacaagggggatatattattgtgaattctgatcaaagctgcccacttcctttagccggcagaaatgctgcaccctgttagttgattgtacaatatcctgggagaaatagggaaaattatgctgttgaatgagggtttggcaactctaggggtttctaaaatgccttgtagaaaaatcatgtttcatgtagaaccttctatgattcaggcatgtgagctgtaaaagtcttattttgccttcttcgcttaattaaatcagaaggctgtgggacttttttcagcttgctctgtgatgtctgcaaacagattcctgaatgacatcctgtggacactttgcccccttttttagagagacaataattattaccacttctttttgaagcatgctgagtggttttatcagttgtttgctaatgagctctgtctctcctttataatgtcaatcataaggatgccttttaaatacaacttatctcccagatttattttcttttcattcttcctgatcaaggtacgtactgttttgcttcagggaatcatctacacaacccaggcagagaaggctggcctctttgatctcttgtggataacacactctctccttctgagaacagagctttccaaaaaggacattaccaccctccagatgagtctcttcttgtgttttatctgtgattttaggttatcattgccctctgttacacgtctgtattcactgcttttcaaattcaatagcatgtaagagtctcagtattaaaattatcctgagtcaagtgagatacagaatgaagcaggaacaataggtcttttcttccttccttctctcttgggcttctggccagcatgctggtatggtttgttcagattttatgcaaagctttacctggcgattcaccaaatcaagtcagaaacctgcacctaacatttataaacaacatttcttcatttgatcatcaccttattcttgaagtagctttcagtgctttggctatttaagaagtcagtattgaaattcatattctacccttgcacactgtgtgagctcactatatcccttgtgtggtgtatagaggaagtataattttccccaagtgccttatccttaaaacaagagatagctaaattgatcagaacgggatatcgttataggaaaaattgtatacattaaactttaggtgtttctgttaatagttcctactactgtgactattcagattattgtattccaacataggtaaaattgatggatttagcaaataaaatacagtacacctgttcacatctgaatttcagataaacaatgaatgcatttttagtataagtatgtcccaaatattgcttctaggacacatacaagaaattgttgtttatctgaaattcagatttgaacaggtgtactgtattttacctggcaacactacatatagtagaattcacgttctagtctttgctagtctgtagatattacgttcccctacttggtaactcctgtgaactgaattgtactgcccctacactgctattcacacggtgaagccctaactcccaatgagactgtatttggagataggatctttaggggaaaattaaggttaaatgaggtcacaaggatggggccttaatcctgtagcactgtgggcttataaaaagagagaatctctcttaggtgaggactcagcaagaaggtggggtctgcaacccaaggagagagccctcatcaaaacccaataatgctgcacctgaatcttggactcctagtctccagaaatttgggaaaataaatatctgttgcctaagccacctggtctatggtattttgttacagcagcccaacctgatttatacagtaactttaggatgtcttactagggcacagttttatgtttcttgctgaactgagatctagcaagcatagtcattaccttagatatggtatggctgtgtccccacccaaatcttatcttgaattataacttccataattcccatgtcatgggagggacccagtgggaggtaattgaatcatgggggcgagtctttcccgtgcggttctcatggtaatgaatgggtctcacaagatctgatggttttataaatgggagttgccctgccctgcacaagctctctttttgcctgctgccattcatgtaagatgtgacttgctcctccttgccttctgccatgattgggagcctccccagccatgtggaactgtaagtccattaaacctcttttgtaaattgcccagtctcgggtatgtctttatcagcagagtgaaaatggactaatacattaaatttgttaccagtagagcgggaccctgctgaaaagataactgaaaatttggaaataactttggaactgggtaacaagcagaggttggaacagtttggagggctcagaactagaaaggaaaacacaggaaagtttggaacttcctagagacttgttgaatggctttgacaaaaatgctgatagtgatatgaacaataagttccaggctgaggtggtctcagatgaagatgagaaacttgttgggaactagagcaaagctgcctcttgttatgttttacaaagagactggtggcatttttccccttccctagatatttgtgcaactttgaacttgagagagataatgtagggtatctggtggaagaaatttccaagcagcaaagcattcaagaggtgacttgggtgctgttaaaggcattcagttttataagggaagcagagcataaaagttcagaaaatttgcagcctgacaatgtgatagaaaagaaaattcaattttctgaggagaaattcaagctggctgcagaaatttgcataagtaacaaggagccgaatgttaatccccaagacaatggggaaaatgtctccaaggtatgtcggagatcttcacggcagcccctcccatcacaggcctggaggcctaggagaaaaaaaaatggttttgtgggccaggcctagggcccctctgctatgtgcagtctagggacttggtgccctgcatcccagctgctccagccatgactaaaaggggccaaggtacagctcaggccatggcttcagagggtgcaagcaccaagccttggcttccatgtggtgttgagcctgcaggtacacaaaagtcaagaattgaggtttggaaacctctgcctagatttcagaggatgtatgcaaatgcctggatgtctgggcagaagtttgctgcaggggcaggatgctcatggagaacctctgctagggcagtgcagaagggaaatgtggggttgaggccttcacacagagtccctactggggcactgtctagtggagctgtgagaagagagccactgtcctccagaccccagaatggtagatccaccaattgcttgcactgtgcacctgaaaaagctgcagacactcaatggcagcccaagaaaacagctgggagggatgctgtactctgcaaaaccacagagatggagctgcccaagaccataggaacccacctctcacatcattgtgacccagatgagagacatggtgtcaaaggagatcattttggagctttaagatttgactgccctgctggattttggacttgcatgggacctgtagccccttcattttggccaatttctcccatttgaaacaactgtatttacccaatgcctgtgcccccagtgtatctaggaagtaactaatttggttttgattttacaggctcataggcagaaggtacttgcctcgtctcagatgagacgttggactgtggacttttgagttaatgctgaaatgagttaagactttgggggactgtagggaacgcatgatttgttttggttttgaaatgtgaggtcatgagatttcagagaggtcggggtggaataatatggtttggctgtgtccccacccaaatcccatcttgaattgtaactcctgcaattcccacatgtcatgggagggagccaatgggaggtaattgaatcgtggggtctggtctttcctatgctgttctcatgatactaaatgggtctcacaagatccgatggtttaaaaatgggagttgccctgcacaagctctctttttacctgctaccatccatgtaagatgcgacttgttcctccttgccttctgccatgattgtgagatctcctcagccatgtggaactgtaagtccattaaacctctttcttttgtaaatttcccagtcttgggtatgtctttatcagcagggtgaaaacagactaatacaacctttctagtctggacatgttagtcaattactcttctgattctgagcaagtagagacaactgaaggaatctcccaatggttgtcccttaaacgtcaaattctatgattggctaatttctcaattttgatcatatcataaatcagaacaataaagagaaatcatggggggtagatgtgacaatgaacccagcctactattggctgaaaaatattaaaggcactgatgggaacatttaattgagtagacaaatgggggagatagcctgactgtcctctgactttgctgttagcatctaaatctacctaaattattggatgtatttacaaggaataagggcagtgtttgtttgtgtgtgtgtgtgagggtgtgagtgtgtgtaaaggtacacagagcatgtactaaatcaagattcagtaaccccatttagaaaggagcacctgagacttctgagaggttaatcacaggcctccatcacccttctaagtggcagaattggagaccatcctgcagccaaagacatgccttttcctccataactgactacctacattgaaaactagaatctcacatttttcacaatagatcttttgtatactaagaaatcagtaacagtgcatttcctcaaattgacatgaagcaaaatttcatccatcttccaacaacctgtcattgttaccccctctaaaccttttcttcttcataagggcaattattattttattacctctggtatgatattaaaattatgaagactttcctccaaggggccaccatattactgtctcatttacattcttatactaaaaatagatttttttttataccagatgtggtaaaatcaaagctaagttagacagaatgggtgattcctcccacatagctgctctggagaacatcgctatgcaccctgaagtgtacagggtgttcatgcccatgttaggtattttagttttgttaatgaggtggtgaggttgaggtgaagctcatgactaagtagaggcagaaatctctataaagaccaaatgtttattcagactgatgtgagaactctttagcttctgattctccaagaacaaatgtgtcataattagaagtaaaaaattgatgtgaatgggttgctgtttcccaggtactaaaagtgaccaatgaagtgtacggctagctgctggacacaagtccctgatactcaaggcctggttgagaagaccttgtagttgagcaaactcatttgttattatattttttaactcatcaaacttgaacttgttctttttcttttccttttttgtggctcaaatagtgatgcatgcagcacaacacctggatttgggcaaatgattttaaattcacacgtaaaaaccatagcaattttatgatgaattggcctccatctacttctgaatttaaactttgctaaagggaaaatccctacattttcttttctttttttttttcctttttttttttttttgagacggagtctcgctctgtcacccaggctggagcgcagggggtcgatctcggccaatgcaagctctgcctcccaggttccagccattctcctgcctcagcctcccaggtagctgagactacaggtgcccaccaccgtgcctggctaattttttgtatttttagtagagacagggtttaactgtgttagccaggatggtctcgatctcctgaccttgtgatccacccgcctcagcctcccaaagttctgggattacaggtgtgagctaccgtgcctggccaatccctacattttcttaaaatttaagatataattccattagcaagaaacgtcagagtgacattttaagcaatgcttgcatcagacaaaaaatgtatgatgtatttgaaatctattgacaacacattggaaaaccttcaagagttctaaagcagccgttactctgaaatttaaaataatcccattttagattctttcaattatagttaagaggattttgtaaaggctgtacctgtagccagtctgtaggtaattttaataacaagtggttaacttaaagatcttcctgtgttaattagtgttcttttttaaataagaattattaattaaattctcaattcagcaaaagaaaccttattctttaatcaatgtcacaaaattctccatagtcaaacttagatctcagtttccgtgatgagtggctggggaaaggaatgcgttctcccaccattaataccttttgagccaataactctaggctgtagatccttagctagaaacgtttttgtccacccagaacacactttgcatttagactgaggcctcctttgaaattctggctcctacatttcctatctccttgacactgggcaattcagttttccttgctgagaatccatcctctgttttttgtttgttcattttggttttggttttggcttttaaatcgagggtagtctgcagtcaagaaatatcactggaagctgggtgcggtggctcacgtctgtaatcccagcactttgggaggctgaggcaggcggataacttgaggtcaggagttccagactagcctggccaacatggtgaaaccccatctctactaaaaatacaaaacttagccaggcatggtggcacatgcatgtagtcccagctactggggaggctgaggcaggagaattgcttgagcctgggaggtggaggttacagtgagccgagatcatgccactgcactccagcctgggttacagagagatactctgtctcaaaaaaaaaaaaaaaaaaaagaaaatgtcattagtctttgaccaatatttatccagtccttatccagccccagttcctagtaatcaccattctactctctgcttcagtgagttcaacttttttagattccacgtatacgtgataacgtggtatttgtctttctgtgcctggcttatttcacttaacataatgccttccagtttcattcatgttgtcacaaatgacagaatttcctttttttctctaaagctgaatagtattccattgtgtatatgtagataccatattttatttatctattcatctgttgatgaatgtttaggttgattccatttctgggctattgtgaatagtgttgatataagcgtaggaatgtaaatatctcttccacatactaattttatttcctttgtctatatatccagtagtgggactgcttaatcatatggtacttctattttaaattttctgaagaatcaccattctatgttccataatggctttactaatgacattcccaccagcagtgcacaggaggaataatttcaagaaatctactgcataatatagttatgactatagttaataacaatgtactatatacctaaaaaattgctaacagtagacattaagtgttctcaccacaaataacataaggtacaatataggttaatagcttgatttagccattccacattgaatacatatttcaaaacatcatgttttaaaacattaaaacatcatgttgtacattataaatatatataatttttatgtcataaaaaaagaaatgtcattatcattctttagtgacaattcacctgaagtcttcttacccatagttgatgagtgtcttttaaattataaagctcaggaagtatgcctttaaatcactaaccaatatctgtgatatggtttgcttaagaacatttttagattggagaataatttacaaatctaggtctttcatttttaaaataaatcatggtgttagttcatgatatttgggccatatttttaaatcctaatcctgggaaaggtggttaggtatatggcaatttatgtctccactgaatttccatacagaatgccagaaggtaccacagataaagcaagagctttaaggtcaatcacagctgagtttgtatgtagttcaagtacttactggctgtgtggttttggggtaatatacttaacctttctcaatctctgtttcttcagttgaaaagctgggattatgctttcaaattcaaataataataaaaactaacatttcttgaatgcttatcatgcaccacaggtattgtatcatttactcctaataataaatccagggggtggctactgttatctgcattttacaaataaagaaaggaggcacaaaaaggcagagcagccaggcttcaaaaccaggcagagctccagaccaccttgcctctcaaatgtaaacttgaaatgccagacgatctttccattttccccaaccaaggactgacactgaggctgaggagaattggcagaagagagagaagaatatctggagggtttgttcctttttcaaatcagcatttaatagccctgttaaattggcaggcgtgtatattactgaccatgtttctattttcctgtaacaccaaagagtaaaggccattttttttccctatgaataaaagttgtcacggtcaggaaataaaccatatagtttgtctacaaccatttcccttgtgaagctaattgattttggctagttaaaactttatgtctaaaatcaaggtccaaagaagaaagtatgtataccttctatagcatttataaagagaccaggcactatgcaggaattggagcaaacatttgaacatatttgtattcttcatatatttgtctctataaattatataaaatccatttttgtagatacagagtataagattcctaggcataaaaatgactaaaatgcaattgtatataatatcagctacctgcacttgtttttctccttcctaataccatctcatttttttggggggttgaaactgagaaacaaagatattaaataattttcctaaaatatacccatacaactaaatgggaaagccataatataaaccatccctcttaatcatcatgatattaataaggaagacaggtgctaagcaaccatatgttgactgggctatctatgtagataatcaagtccctgagaatgaggacagagtagaattggagagtgtgacagtgaagcaacaataacacctttcatcaatgagtaaatgaccaggaaatccacagatgtggagcaagagagtagcacagttctctcaatagaaccatgttagtgttgcttgtttttgtatctgtcttgttttgttttcctaacaagaggaagaaggagaaattgaagaatgatctggaaatgtaaggaggctgttgattacaactgggggttcaatttttcactcattgtcatattataagccgtaacttagttgttattcaggaaataggctgaaagacactggcagatgagaattgcagagatgggaatgctctgaagttagcagtgtggccaggtggccaggataatcacttttagctggccaaaagatgatcatttctgtgggaacatcagcaagtgagtgacctgaccattttaagtctcttccttagggtcctccacatccagcctgggtaatatgttgctcaatctgctttaccacaccaggcaaaacaagtattgaatttcaaccaatgatcacagatcttgtattgtctcatccttgctggtactgttcgcttttctctggctcaattgttgccttttaaaactctttacttaaaccagccactgggcttttccttggggacaatgtagaagaggaaaacaatgatagaagggggtgctttttatttcaggtacagctgggcaggtgggatggatcagggaaaagctccaaggatgtcaagagtagaaatagtgatgtctacctttgaaactacaaaactccctacacaaccaagtgattggagctttgaaagcaatgcggagtagaaaactaatagaatatcaacctagttaaggcaagatttgctgtggggaagggaaggtcctgagcctctatttggccctgaggcttatcaacctgatacttcagttgggctcagaaagactcctgccccctccccattccctccctcccattgtgagggaccaatctctcttattctgtgttttcttaccatctcttccaccacttacctgctctactctgctttgcacatggtctcctcaactatgcccttccctacagccttttaaatgtggaaaagaaacaaaacaaataacatgatcaagaacttaccggtttccaggccaagtgcagtggctcacacctgtaaacccaaacactttgggaggccaagacaggaggattgcttgaggccaggaatttgagaccaacttcggcaacctagcaaaacccccctctacaaaaaattaaaaaaaataactgagtatggtggtgcacaattgtagtttcagctactcaggaggctgaggctgtaggattccttgagtctaggaggtcaaggctgcagctagccactgcatgccagcctggacaacagagtaagactctgcctcaaaaaaaaaaagaaaaaaaaaagaagggaagggaagaaggaaggagggaggaaggaagaaagaaagaaagaaattcactggtttccaatgtaacaaatcctttatctcaaagtagatgtacacttagagttggagacttttttaaaaacaattacaatgtctcggctcttgtgaactgagtttgctgtatggttatgtcactgtggataatgattttctcatttttttacacaatgtttatcaactttggctgtgcttcctctcctgagcatgctccttgttttgtaaaacaactggggaacattgagatttttcatataatttctgtgatgccaggctcctaagggataaagaaatacaaagaacagtgactggacagattgagtggagctttgaaagcaatacagagtagaaagataatagaatatctactataatgacacatgcacaagtgtttttattgcaacactatttgcaatagcaaagactaggaaccaaccaaaatgcctatcaatgatagactggataaagaaaatgtggcccatatacaccatggaatactatgcagccataaaaaagaataagttcgtgtcctttgcagggacatggatgaagctagaatccatcattctcagtaagctatcacagaaacagaaaaccaaacaccacattatcactcataagtgggagttgaacaatgaaagcacatggacacagggaggggaacatcacacaccggggcctgtcagggggtgggtggctaggggagggatagcattagtacaaatacctaatgcatgtgaggtttaaaacctggatgtcgggttggtgggtgcagcaaaccaccatggcacatgtatacctatgtaacaaacctgcacattttgcacatgtatcccagaacttaaaataataaaaaaaagaaagataatagaatattaacctggttaaggcaagatttgtgttttttaaaacatatattccccattaaagactacacatgtacttcttaatgttattaactttgtcatgtattaagatgaacagaaaggcatttctattatatgaattttttcttattcttgtgtctttcaaaaagaaaaaagaaaataaaacaaacaaatacacactcaactctcccccaaaaaaccaaaacaaaaacaagcaatgcaataatatttctcaaaagatatgcttgacacactatcagaagttctgccaacttcaatctatgcactagaagtgcattgaaaacttttattctttgcttcttgtctttaatattgttgtaaattcaatccacttcactggcattacctgctagcaacattccatcttcacatttggatgagtgtgaacttatcaaggtgacatatgtgtgatttttaatggaaattttactttgtttttcttaaaactgggtgtcaattagcagtgactcgcctccttaacaaaggaacagggtttgctgcctgcccagccacacagcccctggggggcttcctagcctgggctaggctgctgcaacatcatcacactttattagttacagcacagagttatggaggcaggaggaaagtactcactatgcaattttcctgataccccatgaggcctgagcacctcaaggtgggttagcactcatggaaaatcagtttaagatgggaaaatttcaaacatctttccttattttctttcccacacacaaatagaataatgcattttaagtaacaaagaacacttaaaaagcaaaacaaaaacaaaaagacacttatccttaaaagccaccatctccttaggatattcctcttatattaaataaggatacaaagagtaaagtgtacttaaaatctctcacaaagattggaaataaaatcttcaaaaagtgaatgcatacaatagcacatacgtaggacgtaattcattattattgggaaatgaaaatgaaagcaccatggtacgataattctgaataagaacaagctaattacattagggcagctttcagaaaacaagaatttatttttttatgacaaatatgactcagtacaaagtacacaaagtattttctgactcttactgtgatatgcctactttatttcaagtaaaatatatgaatttttaaaaggttatgaaaatgtgtttatgctttaaaaaaatcatttcagtaacatgttggatatctggaatatccatatattggaggtctgtgttctcagtctacaaggaaaattgccaaatccactctagagtgccaggcttaaaaaggtgttgaagagagcctgcccgattacctgaattccaatttggctcacaatgaaagatagaaaaattacctagatgcatttcaatgttgcttctccccttgcaatagaccttatttaatagcttattacactcagaaaacaaagcatattttaaggaaagaactcacgacgcatggttcctgtctcttgacagaacggcctctttgaattcttttgtcaatttcatagatttctaacaagcagagaattgttttttaaatctgattttttttaatgccagcagcactatttcctcctcttaagtaggacagattcatcctttaagcaacaatggatgcttccctgctgaactcgagcatgacagattaagcttcgagcagaccagtaaatgccacctccccacttaacaaggctgttcagagccaggcgtctggggcctcgccgtatttgttcctggaatcactgtctgatgagccactgctgtccgaggtggccaagcagccctgattgagcgagctatgtgaagacccgacaggggcctggcagggcggcgggggcatgcctcctttttggtgcttccaggcaaattccttgcctccaaattgtgcccgcctcaggacagttggcttgtacaatgcctggcagaaagtagacactttgcacttgtttactgaatataaaagagaaaaatagagagagaaaaaatctgagtttagagatgcctttcagaccttgccggataaaatgctgttatttctggcaaagtggtgaggtgacactgacttggaagaataactaagaggttaaaaaaaaaaaagtaggactaacagtgaacaagctaataaaacacatggaaaccaaattagtggtagccaaaatcaataatagatccattatatttcaaaatatcttttataagaaaatggcacttggaatatgtttctaaatgccttttagagaccagtgtgttgcataaagaaaaatacacctgcatccagaattataattttaagaaccattatttagattgctgtgaggtatcttaaaatgcgattcaatttgctccttagatattgcatatcaaactataaaagcaaagctacattgttggctttctccctttttggcaaagaaatagaattgagaatctgcctgttgaggtcagaaacagactgaatcaaaaaatatgaaagcatgaatgtactgttctcacatttatgtaattgatggctattttacttgttgaaatcttaagtctttcacaaccacatgcgtatgtttgtcatttatccccttttctcaggtgcaaagaaggctaccaaggagtccgttgtgatcaatttctgccgaaaactgattccatcttatcggatccaagtaggtcaagcatttttcttctctctaatgcaatatataggcagcgtttattctgagcaatggttgttaactcagctgaaagctatatttcagtcttgtgtctctgaaagctgccaaggacagaagctgatggcagatgttgatgttcaaagcatcctcagagctggctcagtctaggtcttctctgacgatgaggcctggcttccggattccaccttgaacccctgctgggaactcccaacaacccgggcctccttagctttccttctgcccagccacgtaccacctcatttcaaaagcagggatctagaaaaataacagagcttattatttacctgaaataatgttatggaaactacagtattataccgcttcttacgctttggttgttaatttatgatagtattaaaccataccttactaaagtaagaaaacgtgtacgaaatcatgtaagaagttttcaagcagactttgaaaactccatttttggcaacactatttgcatatcagtgattactgtcctaaggacaaattattttttctccattcatggaagaagacaatttgcagactaaaaaatatggctagtcattagtttgtttgtatggtagtaaaagtaaccttttatgcttaaatgcccaattctagtcaaatgtgaaatgtttatctttaaagaattctctgttctttcaatagctgctagaattgaatcatgactaaaaaatggggattttcattgaatcagcgatttagtttagtgaggataatgataggcattttgcaattggaaaggccaagttatggttttctgaatatcatacatacgtaacacagacttcagtaaatattttgtactgactaaggacagaggtcgccctgcctgtgtctgtgcgttttgctgcataatgaacgtgtctaggcatcttccaacatcttttcaaaatgcatattttcatttccccctgaatttctagctacatttactcaagtaaatgcaaagttatttgaaagaaaaaggttttgtttaatttaatttaattctattttatcttgacgaagcaattcaccatacagtaactactctttctttgcaaatttagctttccttgagaaaagtgaaggttgccacagggatatctctatttcctgaaatgtgagacacagttctctgggaattacccaaagaggatggtattactggagtttttggtatcttatttatcaagtgatttggaccacttgctcaggtggcctctgaaagggtattcatggttatgatgtgagacatatctttggcatgttaggaaacttgcataaaataatgggcttgctgatttctttctttttctttctctctcttttttcctcacttttcctaatgtatctagtttttctctttttctttctctcttttttctgtttttatcccttctcttttcctatttatttcccttcattattttgtctcctttaatataatacttcttcccttcctccctctttcccttcctccctctttccctttccccctttcctcccttcctcccttcctctcttcctttcttctttctttcctttcttccttccttcctccctccctcccttctttcctgttttgctttcttttcatatgtggctgtggaatagctattcagtacaggttacaaagggcaaggtcttgcatatggtacaaagtgggtaaaaaaaacctctttaaacaatctaatcaaatgttaccagccatttagataccatagttcatcactgcaagagtggaggagggggtcaccataatgactattctctcctcgtagaacaaaatggtcccacggttacagtcactatccctgaaaacctatttcaatgtctattaaattgctattaaaattatagctgtgtgagccaggcacggtggttcatgcctataaacccagcactttgggaggcagagatgcttgaggtcaggagtttgagaccagcctggccaacatggtgaaaccctgtctctactaaaaatacaaaaattagcctggtatggtggcaagtgcctgtagtctcagctacctctggaggctgagagaggagaatcacttgaatccaggaggcaaagttgaagtgagccaagatcacgccactgtactccagcctgggtgacagagcaagactctgtctcaaaaaaaaaaaaaaaaaaaaaaaaaattatacctctctgaaatgtttctattaagtgaaactgcaagataaaaaattacttttatataaaattgcaaaaggaacatactttgccccaaatgtagaaaagaaatacactaaaatgttgtaaggacgtggaattttatgaaattgtttttctatttctccagttttctgtaaagtggtatatcattatgtgagtcaaaatgccagaatccttgaaatttaaaaagaaagaataagcatggagagcccatggatgagtccttgagacacagcttaaatggaaaagcattatgtcttgcattcatccatgcacacgtgcatttctttaggtaatcattaattcatttcatcagtattttctcagcatccaccaagagccacctaattggtcaggctctgttaatacaaaagtgtgcaaacaggatttaggccctgaggatcccgcagattagtgagggggaaaaacatgtggatatataaacatggggatgaatttggtgtaacatttacccttttccgacgttagcagatttgattcggcttccaggcctcaggctttcacttgagcaatggcaacagtaatacctataagcattattgttatcatatagatggacagagtcaatgccagataatgtcagcccacttcccttattcctcactataattgttactaatacgcgtttaaatgatacatgtgccaggcactgtgccaaaggctttacatggattattttattaaaccctcacaatcacagtttagtaaggagactgctgacaattgcccacattttatagatgagaaaattagacctcagggaagctaagtaaacttgctcaaggtcatacagctagttaatgctagagtttaacttccattccaaatgactccaggacctgagctcccaactgaagggcgctttcctccctcccctagaaccctcccttctctagttattttcaacaggacatttatcactctaaattccactgactgaaactcaatgacctgcggcaaacattattctaaggaacaatatttgcacaattttcatatcttaatgcagcaacttgagcttccatagagatttaaatccctaatgaaatttccttgtcaaaattcttgctgaaggattgtttaatttgctgctcatgatatcttcagaatgactgtatgctcaggaaataagcttccactcaactccctccctccattttttctcttctgtctcctctcttctctccattccatcttccttccttcctccctctctctcgtctgtccagtgcatacttttgctgagtgaaatccctattagcagggggtgagaaaccgctgctcttttattctctcccaggcaatgcaaagttagtcagaaatgtgtatcttttacattaaattttaaaaataaaatcttaaatgacctatatttaggaaaatggtgcaaggatgtcactgtgagagccttactggcttgagtgtcttagcagtggttcagagctgggtcctcagactgtttcaaaaactcatcccctctgctctcttttaaatcccaagaacctatagctaactccattcaggaacatatttacctatgaggatcaatcttataaagtgtgtcagtgacagtttttgtaaatatatctaatgcaccaatctgtcagattaatcaaaccctcctatggattcaatgtaccacaagtcgcattcagatcatgaggctgaatagcaagcaggagttcagaaagaatgtagtgagtgactcagactttggtcagagtcaagaggaagtgaccttctgtggaggagccggcatcagctactgtggcattcttgaagggcatatttctgcctcctgcctcctatgctgccagcgcactgagggatagcagcagtaagcttcccggaagctgacttgtagactcctgccctggttttccttccttactacccattcccacccagggtagttaccatcctcagccttgaagcacagttagatggagctgaactatgtgtcagtcagaactgtgagccagcgaaggtttttctccatctcccctctcatgagcacatgccaggctgagttcccatcaagatcctgacataatcaccagccaatggaagcatgggggatgctgcagagaacagactcagaacagaatcaaagaatgcagtggggtagagaagatgcccattggaagcaagggcacgcctcctcacacacagctggagacagccgtttctaccccaccctgtgcctttctctccctgtcagaatccagtacttagcatattcctggctgtgatggcaggcttgagtctgcaggctcaagctctggcaagcagtgtatacagcttaaacacttggagtcgtctagcccctccgtggaaggtaggagcatcacttccatcatgtattcatacgtgctgacttcgattcgcactttgtttctttgcatcttagaaacaggctctgttctcaaagcacctggaaagatgctaggagcctggtctggatgtgattcagaggaagactggtgaaaaatatgatatggatttagacttcccatcagcccactgggtttgtgtgcctcagctttccaggaagaaccacttcacaagtccctaaagaaaagaaaaaaacaatcttcggtagagtgtgttctagcaccagagagggcatcaggtaggaaaataaatttataaacacagccccacttccaaatggcctgcagagacaaccaaatcatgcccaagcttggtctccttcctcatgttcccagggattgtcattcccagtgcctagaccatcaggctcagagccaagtggtgcccctttgccatatgtgtcacagtgaaggaaaaaaaaattgagaacagcctgggaatgccaatgtagggccaggagcctgggtaggcatttgctaagcagacacaaggagattttcctgaagattattaacagaaagttttcccccaaaagacccatgttctgtattcttgcctttctcaattgtatttaatatataggaacatgtgttctgtgtgtcaacaattaggtgaaagggtgaaacaaaaggtgctctgaattggaagtcaaagggttttgttctaattctgtgaccacctgatctttgtggtgtggcctttggcaaagcacagtttatttggaccttggtttctttatctgtagaacaattccatgggcatccagcttaaagaaagtgatggccctcagcagagcaggctgtcttgcaagccattcagaaggggagttcagtgcaccaccaaactagtggatttcttcactcattcattcatttccccagataattaagcatatgtaacatataccatgctttggatccaaataataataatcacagatcctattgtcttaatccatttgggatgctatgaaaaaataccattaactgggtggcttataaacaacagaaatttatttctcactattgtgaatgctaggaagtcaagatcaaggtgctggcaggttcagtgtctgctgtgggcaattttctgatagagggtgcattctctgtttccttacattggaaggcatgacacaactctctgcgcctcttttggaagggcttgaatcctattcatgaggatttcttcttcccgatctatcacctcccaaaggcactgcctcttactagcaccacattaaggattaggtttccacataagaatttcggtgggacacaaactttcagaccatagcatctaccatcagtaaactcagtgtagttaactgtgtttattgacattgaattacagactacaaaggacgtaatgtctgcaagatattgaaatgttttcttccttcactcattcaaaatcttattaatagtttgacattggacaagttgcataacattaataaaccctggctttcttctttataaattaagatattctaatctgtaacatatatagctgttgctaggatgaaataaaatactccattcagagcatgtcatgcttgggacattgtgagagctcaataaatattatctattatcatcattattatttttgttgtttcaactgtcaccttgattagtacacagtgtacaaggcactgagacaggtgctactaaggattaaaaagcatgcagcctattacctggcctcgaatatctccagttgtactgaggaagtaaaaatgcatgaagaagtacaaatgaggacacacgaaagacatgattgctaaggaaatataaaaatggaggggcaataaaagttcacataaagtggaaggagagatctggtgttaggaaaggatttctctaggagagaagattgcagtgagctattcacacaggatgtgtatctgtgaactgttgtacaagctgcacactgcccgacttcactggtatcatttatgctagagtgtgaagggccttctgtggagggttgcaacttggtcctgggaaggacatttccatgaataaattagatagaggaaaaacagattcttgaggacacaaagcagaaactaattatcactttcccctggtctattaatccatacagatgaaagaatgtatcttccagactggcatctgctgggaatacttaagtctgctaagctactctgccttccaggagccataaaaacattgttagcagaatggatttatatgtaaaatctgtcactcttattaccgtttttctggcttgccatgagaaggagaaacagagaattatctgattttgaccatgtcaccatgaatctcacaaaacccattaattctgtcaggttgtatatttttatatatttgattgctaatatcttcaagtctttccttttaaattatatagacaccaatcttttaccaatcatgtatgcaaacacatgatttctagatactaggaaaataattttatttacaagaaaggaaaaatttcctatgggtacctgattcagagataaccactgataatcaattcgtgcatactactccacatattttctactttttctgtggcatacatatgtattcatttttatttgtttgtttggtttttagaggcagggtcttgctctgtcacccaggctggagtgcaatggcatgatcttggctcactgcagcctcaactttctgggctcaagtgagcttgcctcagcctcccaagtagctgggactacaaatgcctgccaccacactcaactactttttaaaaaaatgtttataaggacagggtcttgctatgttgcccaggctggtcttgaactcctggcctcaggagatcctcccatctcagtctcccaaagtgctgggattacaggcttgagccactgtgccagacttgtatttggttttaaccattatgttgaaagcaggcctcacagggccagagggaagcccacctgcccttgcctctctcagctagagtgtttgggtctgtctgcccagcttgctaactacagcttccctgttggccccggctcactgggggccactctacccactctacccgggaagaggattgttcttctgtcctcccagggggcctgttcagcaggtctgaagacagttcccaactggttctcggttctcctgtgtggtccacagctattccacaggacatgctcactatattgtatcattgtgccctgggagagctgggcattcaggagcctctgtcaccagactgtcaggatcaaagatgacacttcctctctgtcatctctcctctgtcctttttatagtttcaaagtcagagagggagatcaagtgttatggaatggttctagattatctaattatttcctttataaattctgcgtgtggtgttttgtctcacacttcattatctattattcattatattgacatcttaatcaaatctgaggtaccagaaattaaatattcataccttattacacaatatactcatttgccttacaaaattaggattggctggatgctcacgcttgtaatctcagcactttgggaagccatggtgtaagtactccttgagcccaggagttgaatatcagcctgggcagcataggaagaccttgtttctagacaaaaaaataaaataaaatagccaggcatggcggtatgcacctgtagtcccagctacttgggaggctgaagctggaggatcgcttgagctcaggagctcgaggctgctgtgagttgtgattgcgccactgcactccagcctgggtgatgtagtgagaccttttctcaattaataacaacaacaaaaaaaggaacaccatcaggattatactacctgtattttgtaacttctacttcccactcaatatattgtgagctttttcccacagaattttcttaattttatattcttttaaactattcttttatattcttttataaatattccttataatattataagaatttaacgtaaattattttaccagtcatctatgaagggctgtttagtgggtttccaattttgcctgcttacagtgattaacaaccattatgcgtaagtctctgtaccttgatgtccaaatgatttcttgaggataaattcctagattttgatatattttgataacttttcctccagaaagattatatctgtttacatttccgtgagtgaaaagtaaaattgattttacttttttctttaccaacactggatagtattaattgctacttgtacagggaaaattatataccactaatattttatattgtaccttgattgccagcaatattgaatccttttttcacttgtttattggtcagtttcatttgtacctttatgaatttttaattatttttctttgctcactttgaaatactataatatttcaatcttatttaaaagagtttgctattttgaggataacaaactattcactatcatataatttttccagattgctctttgatttattatttatgatattttttgaagcatacaaaagttttgccttttatggagtcaaatctattaggtattttttaaaaagtagttcatatgggctaatgctatccttagcctaagaatgaaatgaattaacagtaattaagctattcaattttattatatttctatctgaaatttatgttagtgtgtagttttatattaagagtaatatgtttaaaaacacatttaatttttccaacagaatttattcaatagtctgacatttcttgatgatttataaatataaattaattatataatatataattacacatatttggtgttgtctgtggactttctactctgcagataggggtaacaccatgagagtatttagttttaagagaattgtagtttacatttggtaagattatttcctcaatttaaaaatatataattggttaaatatgattcaaccatatattgatttgaacttgattacatatgcattttagaataatatgcttgaaaaacaaccaatatatgatattaaatacaatataggattcaaaacaacatgtatgttatgactagggtgaccatataacttatcatctaaactaggatatttggaaagtgaaaagcagagctatgaataattacactggaataaaaaatatgaggcaaaactatacactcacccaaatttgtaacataaacatgtatatacttaactacataggcttaaaaaaaacttgaaggcactgtattgcaaaatatggtaggattgcacaattttttcaatatcttttgtgtatctcccaattttctgcaacacatttatattgtatatattattatattatttatttttaattattattttaaatttaataaatattaaaagaatgacaataatgacaaatgcttttttgatgattactgccagggactgttctaagttttaacaaataatcctcacacagtgttgtaaggtagattaaatcaattcccactttaatgtgtggaaactgagaaaaataaagtaaataaataaatacataaataaataataaaataaataaaataatttgcccaaggatacacacttagtcaatggaagcactgaaattttaaacccattgggtatacagtctaaaaaaatagaacatgaagaagcagttacaaacattgagagaatcgctttcccatagagttataattatgattcctcacattgcttctcttcctttgagcatcattatttttgatgcaacttttcatactgttctgctgtattaggatttgtggtgtcttctaacaaattgcaatatgggttcctgtgtaaaacttgagggcttggagagaggagggttttatttagttttgtcttgacagttgcaacttcagttgcagtcggagtagggaaggctttgctgcaagccaccttgctgagacatgccctgaggtggtgctctgtgttcatttcctaagcagaaatttgctgttttgagacctccactctgctcatagcatgactccccagagagaaaatcctagcagtgtctctggtctctgcttatagggcacctacagctgaggttggtgtaagacaggtgtctcgtggccatggctacctgctcaagaaggtgtaaagcccaggacaaatgcctaagtttcaccactcgccctaccctctgctacctttgccctcatcctctccatgtgagcaatcttagtagggttcttatcactcctataaggtgtttggagcctgattctgctcaactctccatacagtttaattttatatacaagtttttgtagtgtatttctacctttactgtatttggcctgtcacttatatgtgaggatggtgcctccttctgagatttatccattgatgtagctccccctccacatcccatattcataattttttttcatggaaagcatatgtggggacagtcttttgtgagtattccaatggcctttttaactagaagtttccaaagggttcacttttgagtgagtagaaggaagcactgaaaaaaaaaaaaaaagatggaaaatggggccaagactacccgaagattaaaagcaaagaaacaataaccacaaaacccaattagccctcaatcaaaagggtccagcacattggagattactttcattctgccatccatagctttctgtgcttctttctcatagtccactttggataaatttcaatcacatctaataacatcacatgtgtcactagacagacacaaccactttctgcaaaattcagaggaaaaccataatcattttcaactctgttaactagactttcctaaatgaatctatttatttacattctatgcccaagagctacattttgaagataaatagcagaattacctatttcttttgatggtgttttacatgacactgatgttaggagacaaccaacacagtgctgtaccaagtaacacgcccatgatcctccttttcctgagacagctattttcatagaatatgatagagcaatttcaccaatgtgtgactgacatgaaatggaatggtttgagctattatcatctttatttctaatttggtactaccagcgtttcagtttttaatatagttttaaaaaattggacacatgaattataaataatatctcataatgtggattaagaacacaaacagagagaagcagaaaaactgactacattgttgacagtagtcagagacacagggttctgaattttctcttaagagaaacatctccttaggtccccttaggcccatatttcaagttccaacagagtttttcatggaatgaggacttaactgagtgccaaatttcatgctaggcctctgtctacacatccttatttattatttctgagttatagtaattttatggttgaggcaacagacattcagataaattaattcacctacaaaaataatcaatttgtaagaatttgaaatcaaatctgctgagtccacattttagccatcaaagggccttttgatatgggccaaccaaattttcttgcaataggaaactttttaatatttattttactttattttttcatgaggggtcaagagcaaaacattctccatcatttattgaaattaatatcttcattaagtgtcatgacaagaggtataattaaaaatgtaacttgaaatatgtcaaaagatggatgcataattagtacagtttggggtaaaatcattgcattaagcaaagcagtccaccgtatataacctaattcttgtacatgatacgcacttgacaaaactgtgaacaattaaaatgaatttttgatgatttgtttgatatgtggataaattttttagaaccagcactggatcttctgaattcctggctcccctaactatttttagtctctccttatgaataagctgtcagtggtcaattatactggttggtgtctccactgtctccattttcttgggaatcttgaaaagtcaatcccttagggaagttttgtttgagaattaaggtggaattgatctggcagataaacattagattcccactgtgctttaaaccatgagaaggttatcaaattttcagtttttcctgatttcttgtcttcacagaaaagctctgtgattatacatgcaggacatttttaaatattgggcataacccactttagttgtccaggaacacattccagatccaataggagtgctttgtggataatctgtaagtggtgttccttaattaagagtgagcaacagggaatttgtaaatcaaaaacacatccctatagtgtaagccaattcagctacaagtaacatttattaacaacctattctagttcatacaagaaaccttgccaggtacatgcacaaaagttctgtcatttaactcttacaagataaagtagctattagtatcctcatttttgaactatgtaaataagattagaaaaggaaaccctagatgaagaacatcatcaagacttattgtaagatataagaagaactaaattgagagataatagcatgacctaccatagaatacttttgtagaatggaattgttccttaaatatctattgctatagttccaaatacaatcctcagactatgtcttaaatgtttttcttagcttttgtttgtttgtttgtttcttgtgtatctaattatggaacttaatcaccagcttgttgaggacaaatatgctggatttggttaccactacatctcaagtgcctttcatgcttccattacatcaggcactcaggtaattttgattgaatgagtgaaagagagacttgtttaaggtaacatgttttactagctcccattttaaatgtggttttagtacacctactttaaaatttatttagtattcacccaatgtctatgactttgctaagaattatggataattaatacagtaacagtatattttattttattttaaaaacctattttaattgaatttaatttttaggatagtaatacattcacatggttcagtatcaaacagcataaagaggtttacaataaaatgtattctacccttatcccccatttacccagttcttctgtgataggcaatcaatgccgttaattccttgtaaatctttgtaaagctactgtataaacgtataagtaaaatgaacaaaaaatccccttatctctttttatataaataacagctcgtaatacacactgttccacatctcgctttttcatctagcaatgatctagctttttcatctaaaatgatcttcaagatcattttatttcagttcatacagaacattctaattctttttataattgtatacaattccattcattgcatatagcataatatgactgctatggtctgaatgttaatgttcccaccaaaaattcatatgttgaaacataattaccaatgtgatgacattaggaggtagattagatcatcagagtgaagtcctcatgaatgggattaatgaccttaaagaggctcaagagctgccttgcttcttccaccatgtgaggacacagcaagaagacgcagtataagtacaagggccttttacctgccagcactttgatcttggacttcccagcctttaggatcataataaatagatttctgttatttataaacgacccagtttatggtattttgttacagcaatccaaagggactcagaaaacgatgtaacaacccatctgtgaatttgcatttggtttatttgctgtttaaattatgctactttaagtagtatatagaataaatttctaaagtggaaaatgtgggtgaaatatatgtacctttatagacctttgggttctcctcattgtcatactactagaatggtaccaatttaaaatcttaaatcctctgttttccaaagcctctttgacatgacggtttgttttatgaaactatatttgtctttgtttaatcttagaagtgaagaatactaactcattcatttttaaatttaattctttttatgatgagtgacatgaaaacatctttttatattttaaaagttttttattttttctttcctgtgaagtctctttaatattcctccccagtgtgtaattcagttattggtgattttcttattgatttgtaggagctatttttatttaagggaaatgaggcctttgattatgacatgagattgaagtagtttttttcttttgatctttgcattttgtctttgattatgatagttcaggcacaacaggaaacttctttttcctttctttttttccatgcattcctcttttctccctccctccttctttctttcctctcttcatttctttgtttttccttccttctttctttctttcttttattcttttattagaataattcattttttaccattgtggctattgggttttgtttactacctttaaaaagttccaccgggagtggtggctcacacctgcaatcccagcactttgggaggctgaggtgggcagatcatgaggttaggagattgagaccatcctggccaacatggtgaaaccccgtctttactaaatatacaaaaattacctgggcatggtggcacatgcatgtaatcctagttctttgggaggttgaggcaggagaattgcttgagccagggagtcagaggttgcagtgagccaagatcatgcctctgcactccagcctggcaaaagagtgagactccatctcaaaaaaaaaaaaaaaagttccttctcactccaaatttattcactaatatttctatctaaaaattttaggaatgtaattatttcagtattttttccttaaatcttgaaatgaatccagacttcttttttcctagatgattacacagattcccaagatcatttaattagtaatattattagcagcatatttgtcagtattaaatcgtatttatttattaataatgtcatattcttataaatgaatgaaaagatacataatgaaatatttcacatttatttggttctatttctattctgttctatggatccatatatttgtacatcattataatattcttaattattagggttttattaaatatattaaaatatataaaaggagagcatacccttcgttagctgtcttccatatcccccaaaatttgtatttgggttttatgaactcatttctgtctcaccagtgattactaatatatacttaggagttgattgttacacttaaaggtagctatgatgaaacatgagttaatgaagcagaagaagccaggctacataatgagagaagattaaaataacagagaaaggggggaaaagaaaaaaaaaaaaagcagataaagattgctttgcttctggaaatggcaacccaactaactctcttatttttttcatagccaggaaagaaaacttactatcatttccaaatgacaagcctcaacccaatttaattagctttaccttgagatccagagaccaatcctgttctatgtagctttatttgactcctaacatcccttgatctttctattctgtggggtgtttcattatctaaagcaaatatatactacttaaacataaaaaattgtaacattatgaggggtgactcattactggtgtgtaatatcatggtaccagacattactaatatgtaaggagcatgagcagaaagacaccagcctgtgtatagccatagactactatgcttttaattgttttgagattgagtgtctcaagatctagataaatcagcaagatgaaagatgctgaacactgacatcttctttgtgccttgtgaaaagaaacaaatgacatctctgagctgcttagaaaagaattatacctgggatagtggtcaagagtggggagatatatctcaggagagtctcaggtagtttgagtttttttcctgttcccttcataacaaacatgattcacagcaaccattgtagtattatcagtaaacaaggctcctgtttacatggtgacctgaaatagaccctgtagccagacatatccatccttccttgttccaaacacacaaattttactatactgcctttgtagtcactaccattttccttcaatggagttactttcttcctgcagtaatctcatagtaatttgtacactcttctcaaacaatcaacctcaaaaggatctaccatttgttggacacctaatacttcttttgaacacttgatctcattttatctcagcctctctgcccaaaaaatcatctagattgatattactgctgtcatttttcaggctagatgctgaatcctatttctagctgaagcttaggccatagcttcacttcaggctgcagcagaataagggaagggaagaatctgagtcccctggcttccactggggtggggagtttcctcagagatagggagaattcttccaaccaaaggaaatttgggaaatattaggaaacaggattatctgctgagaaggacaaaaccattccactgtaaatcaattgattaatccacatacaaacaacaggttttcttgcacaggaaaaactctgacacatattttactttacttttgtccttaaggacctgatgataggcctaggtacaccatctacttcacatttttctaatcttcctgtttaatgtcgcaatcaaacaagaaaagaagcagctttacttgttccttgtaaaccatgttgtccctcagtgatgccagcatcttccactggctcatattgaccaatatttcatacaagtgttcttgcaccttgcagttgcacctagcatcttcctgatttacagtctcagaactcgctctgtagacaccttttttttttctaaactgaaaacgtaccgtttgttttccatcttcctgtaactcctctaagaaagcagatggtggatcagatctcaggccaaagttctctccagatatgggatataatccaagcaacctggtacctgggaactcatttttactcctgtgagctcttatccatcattctggacttcagcagctgctcttcagcgtctgtttattcttttctactgaactcccttctctttgacagaaagcgtggctacagaaaacattctgactaattctgtttggggtcagtcatgaataactttattccaacagcttccaatggcaggcaaatcctttcccggttttacatactaatgtaaaataattctcaaggataaatctatgcttaacatattcaaattaaactttccagtcagataatatattctccttaatgtgcccagtgtatgtagttcgtagtatacactaactgcaatctactgatttatttgattgtgcacctaaaatatacaagtagtacatttcacaagtaagtacaaattcttcttttcagagtggagaaagaaatatatggatcctgtcctcatggaacttatacagatgataactaacactagttactacttaatttaaaagtggtacaaagtaccaggaagtaaatgtccagaatgcaataatgatatgtaacagtgaaacaaactggaccttgttggagagaaggttttcaggaatatattcattcagtcattcattcaacacttgctgtgaaccaagcactactgtttttttttttttcttatttggaaaaaagctgcatatttcattgactcttctgaacaaaggtcattaatacaaaagcacttgtaagttgctttacctggggaaagtattttggtgatttttatctaggtgaagttttctgggctcaaaaatcttttcctaacaggttgattttaataacagtccaaactattccaaaacaaaacaaaactgttttcctctcttcctaaacagaaacaatggcatccggagctgaaaatagcgttaattacatgaaaagtttgtgatgcacaggatttgctctggagtatgaaaagtgtgtcttagacttatgtttatactcacataaaatgagcaaaaaacgatagtcctcttcaggaagagattatctgatgaaaatctgcaaagatacttcaatctttctatgtactggagagtttatgaagccccaaccactgttctaagtagtgagacactttaccactttttgtacacgtgttgggttggagagtgacagattgaaaataaatatggaaattactgaataaacttatcagacagtgataaggtaattcagtagagaatgattagattgctactttattctgagtttcactagagaagaaatatttaaactgagatctgaataacaagaaagaaaattcttcggggaaggagcattccatagggagaaaacatccatggaaaagaccttaagcctgggataaacctgatatgctcaaaacaaaataaaacatacacacaaaatgtcagaatgaatgatgcaatatattggatgaagaggaatgtgatcatatcattgtcatcctaatgacgacccctttgagagtgaaaggagatgatgctctgtataataataaccaggccacaagcaggcatgcagccccttctggttgaataattgagaaacgaaagtctgctagaaggagaggctcaataaatatttgttgaaggaaggaataattgctctcactctaatggaatttttttttaaatttcttaacaaattgatttaattaaatctagttctagatgtatttatattttaaaatattttaatttgggcatttttggcttgatttggtcagtgtctttgtttttagagctccagatggctccaaaatatttttgttctcagcctttctctatgttaatactatcagtgaggccaacttagacaggtgtcccatgtgaattgcaattatttcacctcaaatggtttgtcttaccctagtcaaaacaaagcagctttgatttactacagttgaggtagaagagagattgctgaaggttacaagcctgattctgcttttattgtgtcatttgaggttgacctttatgctccagtaacctccctgaatctgtgtttttccaagtgtctgtaatgctcagtgttgggcatagccctggatgacactttcagatgaggaagtctgctgaacatctggctaaaaagcaagttttggagagcattttaggacttaaaatataaagtctaacagttttctgtattataaatgaccagatcagcatctatagatgtatttttatgagtaataaagtataaggggaaaggcttgcagagagaaaaagcaaggaagagaagtatgtcaatgaatacaaattctctcatttgataagaaaatgtaaaattatgaataaatgtatgacatctcattgcaagatatgataagactcaatttcccctgtttattgtcaccgaatatctaggaaacaaaaattttcaggacttcagtattttagcaggaagaaatctagtgactatagattgcctacccctcaccatctcaccagtgaaggtcttggtcagtagtctgtagctctccattttctgccccctaaatgtgtcttgcagtgagtggtcagtggtcaaatgaatggaacagtagaggcacttctatatcagcatgaaaaaccagtgaaatgctgtcttgccaatactgtgtatacagagagacatttataaaataataagcaggtaaaacttgtcttggcaaaaggctggctcattacattcagtgaatgttaaaaaaaaaaaaaagtcctctgtggtgataagtaaaatagaccatcaccacccaaatcaagccacattaacatcttgaactgctatgctttggatatggtttgtccctgccaaaactcatgttgaaatttgatccccaatggggcagtgttgggaggtaggacctagtgagagatgtttgggccatgggggcagatctgtcatgaagagattaatgtcctcttacaagtaagttctccatctaaagggaatgggttagtctggtgttaaaaggagcctggctttcttggtctctctctctctctctcttacttcctctcttactacgcaatctgtttgcatatgcctactcccattctactttctgccttaaattgaagcagcatgaggccctcaccagatgcagctgatacatgctgagagtaaattaaaccttccagtcaccagaattgttagccaaataaacctcttttgtttgtagaaaatcttgaactttccagtcaccagaattgttagccaaataaacctcttttctttgtagattgcccagactcaaaaattcttttataacaactctaaacagagacattaaccaacagcaggagttaatgaaaccaaaagtatgtcatgaggacagaaaatgtcaaatattttaccaaaatctttgggaagtctttcaaatgtcaaaccaatcacatcactgagatcctgcacatagagctcctggttacctcttgacacaggtagcaccctctaaagtgagagcaccagtggtgatatccttagccaaagtgatgagaagttgtatgttccagcaaaagtagcataacacaaaaacatacaagtgtttgagacaaagaagactcttaaccagggttcctagctttcattgagaaaatcctctcaatacatccttatcactcaaaaaattgaaatccattataataataatcatactaatctattgatgaaataataagaaacagcggaaggaaggatggtaggtaacagtcggcacaagacacacaaagaggaaactctatgggttctgcatgcgtgagttgctgaaaatgagctttaaggttaaagccaggagtttggaattaatgtgtagcatgtgaaatataaaaaactccattcaatgccctcaattttatcagaggattagggtaacctcctggatacttgcagaaaaaagaaagccagcaataagcatttggctgtggcttggaggtttaatttactctcagcatgtagcatgggaacctttttgcctgagttgagaaaatagcctataaactagcaccacaaccccagaaaaacacagggccccagtagagacaaacagaagaacttccaacagagatgcccacagccaaaagcacatctggtctctaaagaataactcatgatgctagtgatctcacaggaaaaattacaacaaagataagaaaaaagcatataagaaaatcttcataagagaattgtcagcagatgtagaaatcaatccagaatgcagccaaagagaaaacatgaacaatgtgtgaattaaaagcagataaatatagcataccaaataccaaggaagagaaaaacattactctgataattaatagcgaagcataatcatcaaaaaggcaaagtaccactatcgtctctgtcatctaacttcatactgaagctttaagtaagcctaataacagaataagaaaaaagagaaagaacattacaaaatgaaataaaactatattattctgcattacagaggctatggttttatctacttagaaaataaaaaaataaataaatagagaatagctaccaaaactaaagaactaataaaatcagcatacagaagacagtcttacatacagacaactataactaattagaaaatataattttaacagattttttaataagaaatctattacattttctgattttattagtgtatgtacatggcaatggcatacataattaaatgtatattacaaatgtaaactaagtatatattgtaaaaaaattaaaaatatcatattcccaacagcttcaaatgttatataacgtagactctcaggagactaggtactcttagaactagaaaaaaaaattcaataaatagcactgaggaaattgggtgcccacatgaaaataattaaatgtatttcatatttttaaaaatctacagatgacttgagctaattataaaaaaaactctaaaactttgagaagaaaatatagaatattttatgatatatagcaaaaatgtaatattttcaaggaagaaagtaaaacatatcgaaaccaaagttaaagcaaactgacttctattttatcaaggcttatctaaaaacacaatagcaattcttcagaaatatctgtggaacccttctaaattaattataacctcactataataaaaaagtaatatcttcaagaaaataaggcatttttagagaccatttgtagccatagtgcaataaaacaagaagcaaaaacaaagtaacagaaaataacccaaatactttcctattccaacaaacaaaaaccaaaactcttctaaagaatccttagcttaaattggaatcaaagctgcaataacaaacattttgttagaaaataacagtagacaatcatcatttaaattctgttgataaagtgctcagcataaaaacctgagactgaattgctacttttcagtaaaaacaacataaaccagaagtcagaaataattttaagagaaggaaaatcaaaagtcaatgcatttgaaaaaataaaattaataaaatatataaaattaagaaataaatcagtttggcttgtaataattccagtaatggaatgaaataattatttagaaagcaaggaaaaacataaatggaatgcttctcagtattttcaaaataaaaaaattaagttaaaattataaaacatatatatgtgtatgcacaaatataaattgtatttttttctttttcctttttttcttctttcttcctttcttccttccgttctttcttctttctttctttctctttctttctttctttctttctttctttctttctttctttctttctttcttttctttctttcttctttcttttcctttctctctttctttctttcttttctttctttcttctttcttttcctttctctctttctttctttctttttttttgataggacctcactctgttgcctaggtgggagtgcagtggtgcaatcacagctcactgcagcctccgcctcgccagctaggtttttggattgtttgcagatatgggttttcaccatgttgcccaggctggtctcaaacttctgggctcaagcaatccacccaccttagactcccaaagtgctgggattacaggcatgagccaccacacccagccacaaatagaaattttccaatttccattatgaatgagaaaaatgaataaaacaagaattataaaattaaatttttcaaacgctaattaaaaatacttgaaaagtttaccagccccaatgtttatataattccatgccatttaaattactttaaagcataggccatacaatgcaaactcaattcattgaataagacacacaaatgatacatgaaatctgacagtgatagcaatacattgaatatataaatcaatttgaattatgaatagtaatgcagaaatgtggaaatcagttcttccgtatacatatatacatttgcatgcatgcctgtgtgtctgtgtatacttgattctaaggaatgaatgaaaataatagttaacaaaatagcctagactttattcaatgtattcaactcttgtcttcaatatattccactgagaatgttgtagttataacactatatcctgtaccaagctttccatgtcaactagctttttgtttagtcacgcatagtatgctgtggtttgaatgtgtgccccaaaacccatgttgaagttcagttgccatggtgatgatattaagagtcagggccgttaagaggtgattagtcctgagggctctgccctcatgaatggattaatgctgttattgtccatctcctctttaaaatgatgcatccaaaagtctctgaaatgcatttgatttgtataaagagttattgccaaactgcccttttcagtgacaacatttatacactaacaaacatggttttttgtgacacctgattcttgcccagtgtttatggggtacagtgatttcatgaaaagcacacctagctgaaatttggggaacaattgtttcatgtagaaagaatgaatcttagattgtattaaaattcaaatatgccatgacaaacagcgaccttttccagaggttttgtaataatcactcagcatgaggatgtcaattaataaatatgtgaaagcacattgataggccacaggaaaaattcatgtaaccatcctgaaatgcagaaagtattaaagaaatatccatttatccttaaagactcttagtaaaatatatttgaaaagtactttcctcatataatgaaagataattatctaaaataaattgacaaatatcaaaatagcaatagaattatagaggaattcctcttaaatttaaaacaaaacttagacttgtagcataaaacaaagaaaaataaaatttaaaaaactattttggattgctgaccaaattaataacaaataatcaaaataattaatatacgagtaaagaacattatcaatatgtgcagttttttgtacttggaaaccccaagataaatgagaaacaactttgaacacttcccatgttcaaaaaaaaaagtgactgactttgaaatcttcatacaaaaatcatttaatttataatgtcttatctgtccagtatggtggccattggtcatatgtggctgttgatcatacagaatgtgtctagtccaaattaagatgctctgcaagtaaaatatgtgtattagaattcaaagacttcatgtagaaaaaaagaaatgtaaaataactcattttactttttaatttttattagatgttgacatgataatatttggacatattgaatgaagtaaaatatgttaaaattaatccatctgtttctttttactcttttaatgtggatagtggaaaatttttaattgcatacatggcttgcatatgactcacattatatttcctttttctttttttttgagacagagtctcagtctgtcaccctgaagtacagtggagtggtcttggctcactgcaacttctgcctcccaggttcaagagatttttctgcttcatcctcctgagcacctgggaatacaggcatgcgccaccacacccaactactttttgtacttttagtggagatggggttttgccatgttgaccaggctggtctcgaactcgtagcctcaagtgatctgcccgcttcagctttctagagtgcttggattacaggtgtgagccaccagacccggcttcacattatatttctattaaaccacattgccctatgcaaatttttttttttttttttttttgagacttagtctcgctctgtcgcctaagtgcagtggtgcaatctcggctcactgcaacctgtgttcaagcgattctcctgcctcagcctcccgagtagctgagattacaggcacccaccgccacgcctggctaatttttgtatttttggtaaagacagggcttcaccatgttggccaggcaagtctcgaactcctgacctcaggtgatccgcccacctcagcctcccaaagtgctcccaaagtactcccaaagtacaggcatgagccaccacacccagccagcaaataaaaaatttttaaaaaagataatatgatagggaaattatttctttttgtaaaagcagtgcaaagtcagtaaactctaggtataaaaatataagatagtataagatgctgcagcaactgtatgattaaaactatgaagctatgttttgggctgtgtgtgtgtgagacagagagagcaacagaaagagaggaaagaaaagagagagagagaaagacagagaagaaggttcctgccatgctccttatttgaaaatcatgtcatatgacaaagtgtagtttaaattatactgcctagaactctttattcagtatgatccaatatcaaattatcaatattataaagaaggaaatgcttgctaaagtgattggtaaattcaatacagttttcattaaaaatatattttggaaagggtttgaactattttaaaattcttcagaataaacacctgagaaaaccagaacaaaaaccagtacctatgaacaatagaaaataaagaagacattttaactaagtaagaaaataatgcattatttaatattgggctagctctctaaccatatggaaatgaaagtataaaattcaattatttttcttacaattcacacaaaataaattttagaggattaaagttttacatatgatacaatgacaaagtaatataagtaaaccaaacaatcaaaaatataatcttattggatggaaagcatacttacacatgatacaaatgttagaattattatagaaatgattataaataaacagaaagtgaaatgggataagttgttcaacctcactgtagcgaagaaaatgcaaactaaaggatgctaattactcagaaattgaaatttatcaccattcattaaattaacactattttccaggagaagtgacaaataccaaaggtaggaatataggaatgaagatgttataaagaaaaaagccataacaaacaatcaattcagtaattcattttacttttctcttttcctcatgcaagttccctttgatggaaaattattgttggaggaatgtggtatcctgatccaaaatgataataatgtggtatgcatataactatttactttcttgtaatgtgtagcaaggtttgtagactgaattttagtttgtggaatgaataaatatcatctatatgaacatgattttttgaattattttgaaatgtcagctcttaactgacatagcaagtcatctctaagtaataaaatttaatatcagatttgatttccactcagaatttgtgtgtttaaggttttcattgcaaaaaagataatatagctttgcagaagttagacagttatttcctattcaattgctttgatgtgcctatttctttgaacaaaatctctttttaaatgctcttttgatatgtgagctcatggttgctctgaaattaatcccaaatgcaaaatgctcgtgaagaatttagagtttgctaaaagtagttattttgatacatttgttgatattttcttgatagggaatgaaccataatttactttaattatttttacgtgtgaatgtacgaaagtaaacagcagcaaccaccactttctaaagcagaaagtattttgtggccaggttttctcttggctcttaggagggccttctcgtctttattgtgatgctgacatgtgatacagacaatgaagactgaagtggtcagcctgaacaataacaaaaatgaccacaactagtcacagacttagaaaacacttctttcacacttttgtctataaagatctgcttatattgaatggaaatgaaccctaaaaatagtctagtttaaggataaggatcacattttataatttgcttgaggttggttgggctagtagctaatttaaatataggtctaaatgttctagtataacattgtttctcttatcctttctgtggtcttgctagtggggatggagtgtgggtagagttatcttgtagttcagctattagaaaactgtttcttcttcatcccagaataaatcttctacatcaagtagtacgctgattaccttctgtaattaaagacaaaaatgtatacatgtatttcctatttcatcagtcagtttgactgatatctgactccttacttattaaatgaagatattagcatccttagtcttttttttaatctctcttccctaggcccttctgtcttcccatttctgttgtttgttaagaacacttaaatatagcgtcaccataaatatatttttcttaccttactcataggtatattttgaaatctagtactctacgaagactaatcaccttaatatgtggatatattgtggatatatatatatatgatatatataaatccttatatatatatataaggatgatatatataaatccttaatatgtggatacaatgatccattgtaaaatcaagtatgaaattttgattatatttcctttcagtatagcttcttggattgttggtccagctagcaactctattaattctctccctccaatactcacagtgaccagttatttcaccttgtctcctggagcacccatctatcacacaaacagataccttctcaatctgctgcctgcatgtcttcttgggatttatctgcactgtttgcctgggttgcgtacttcatttttggattttcttgctttcctgtttttaattttgtttttcctcctttggctaaataaggaccatatattccctgagtatttctagagtgtctgaaaaatgtctttattctatgctcacactaccaggatcttttagcatttttcttcacgggttcttttaatctagagattcctgttcatctgctctattaaatacactttattatggtctggatagttttcatctctacattttattttttcttttctgttttctcattcttaaatttctcttggttggctattggatctcctggattggttttcttaatcttattatcttaccttttcccagtctttgtccatttcttttatttattgagaaatgttcatatattcctagtcttttatttattctttttatcttaactataacactgtaaattccaagatatcagatgtctcctttcctcaggaatttccattacattttacaggtgaaatactttttttgaatgtctctaaggatattactgttggtaatataatattttcttattttctatgaattatctctgttctctctctctctctctctctctctcatcctctgttcatgtttaagagtaaagtatgaggagttctttgagaactctgcgtatgtccatagtgctcctcaccttggagcaggccttcattttaagatgcttgacttggagctggtgtcattttggaggcccccagataccagaatgtcactggagtcacactctctcaacagatggccttccaggctcctttctaaaggcggatgcctgaccactgactgttgcaagtcaagagtaggagaaatgtgtctaggagtacgtattgtatctgtccccctccccacttcatgtgttcagttccatgtctttctttcactttcacgtgtactaggcacgtttttagtctcagacttctctgtggttttactaggagagctgtctcacttctcagttgtgtcccacactgcatttttctccatcccagttcaatagttaccactcttccatggacatgtggccttcaagagtttatagaaactttttataccctgatggttctttatcaacctcttgtttgtcgtagtgacctatttttttatacttacatttatttggttcccatgaaggaaagaaaatagatgcatgtggttaatccctcatccttaggctagaagttaccccaagaaattttaatttccatgttaataacccacctagcaccaagtaattgtagagattttcatctcttcaagaaaacagataaaatatttgtctcatcttctggctttctgtatgcagtatataaaacatttttctttcactgatagcaattcatgttattaactattttaatgatataaaatatctcactttattttaagtaatttaattttatctctttcatctgattaagatagattttctagcttcttaagttgtttaatgcaaagacaaggcttttgacagaaaatccatgtcacagtctaggaaatagcttttttgtgtgtgtacctacatttctgacgttcaagtttgttcccaaatttaaactcaaccctcaagcaatttgatttttgaacaaaaagaaatgttatatgtgttctctttctatgtatttaagattctatacgctttaagaagcaattactaataaaactgagattctaacagtcaaaattgtcagtagttttatcatcatctttgtcagtctttgacgactacagatgaaaggctccaaattgtactagattatttgtaacattttaacccataaagaaaatggaaataaatagtttgtgaaatatggttatcattaccaacctatatgtttttgccattagaagtcattttaacttttagtacataacaactaggatattacataattctcatgtgacttctattctttttaccaccctagaatacctgaagcaccagttcaaaggctgagttgtacttacatattctaaatgtttccatagttcctgcaaatattgactgatatcttgagaaaatataccttcaagagtttaatcatttaccttaaattgaaaatttgtattttaatggattctgggctgaattatgactgtcgattttaaataactttaattacttgaatttaggaaaattaataacataatttcaatattaaaaaaatattttgagatatatttctcaagtataatttaagagtaaagcagttcttatcactgtgatatgtgtttaggatatgtgtgattcagattgctgattttaacaaataactattctgcacagtgaagtagaaagcaatagactaggattagaagactaaattttaaacctcagctgtgaaaaatcagaagtctaaaaattactagcacaagtcaaaaaatcaagcctttcttttctcctaagtgtggatttatgtaattcttcctacatatctttttttctctatctaaattgtataaatataaccaaatataacattttttgtgtacacgctcagacatgtatacctaatacagtgtttaagacctgcaagatttcattgatgaacaagttgctttgcttgatattaataaacttgccaatttaggacgtgatgcagacccagccctcatttctgtaaggattgaatcctgagtctgtaacttagccaatcataatgttattaaagtagaaatattctgtacttagtgtgggatataagtgtatataaagcaaccatgaactccacacctttaatgaatagaataaaaatgagtcattatattattcttatttatttagtttttacatgtactcttactctccattctgttttttaaatatgaaaatgaaatagcagcatgactatgcatagtatttcaactacaataaattataaaagtgaaaggcttacattttaatgattataataatttagaaaggcatttcaaaactttccattattttctattcaagtactttagtaaaatgggtgggtatatcaagaatcttagcagagtttacaagacactattcctggtgaagacccctctttccaaaaccctgttgtgaacaaagtcacgttcttactcacagctctattcttggaaacacattattttgcaaattcctaatacgacgattttctaaaaccgtcaacacaaacggacatcctagtttgtaccagaatatgtctccctcaggaggtggcttgggcttctctgccatggctgacagacattgtagaagcagagagtcctgagaaaaacagaaaagccctcagatcagaggaggaaagaaacaaacactaggaggtgttttggcaatttaaacatattccaggttaagcagcatcagaatggacaccagggtagaccataacctcagaagggcatagtagatatgatagaaatgtaggctgagattggagataagggctggcaggaaactcattgtcctccttggagctaagtggagcaaaaaatggaactctattttgggtgtcttggacaaggaacagaatactcaggagctctagggaaaaatggaattcgggtctcccctggggacatttatcagaatgaagagaaaaaataaacaggcagctgcatcctaaaggtatcaagtgagcctctggcatgaactccctgagagttggtttagcaaaagtagtaataatgtgcagatttgtgggacaaagctttttgaattaatgatccaaggatttatctctggctcctggatggtaatgaaagatcatgcaagtgtctcagtacaaccagctagggtgagttaggatgaagcaaagggtgccaggcagattaacattctggtataaatttgttatacttttatcaccttccttcttaaacaagttactaatcttggaaaaattagaaataatatgagataaaatttgacatgctcttaatgaactgatcaacttcaatgatctaatcgagtcatatgaatgaagtattctttttaacgttaaaaaatgaaatgttttcaagtgattaaaaatttaaaagaagacataaaataaagccagtattttattctataaccacctatgttgggatgtaaatcataggtactatagttgctgacaagggttccattctggtgtatggaaaggcatcccacagttatagtcaggctcatttactgtggactcgtgatgcccccagcagtctggctgatcttcagaagtgtggcaatctgttcttattccatgtaagtttgtctaccaagctggttgccgcagagggaaaaacattcttactgcttagaggaaaataaacttattcacttaattattcattcaacacttaccaaaattattaatacttaatcagtgctaagtcctggatgagctattcctcattcaatgaagaattgatgaatcactatgttataacattagtggctgacatcaaattgtccatctcaatagcacttcaagcaaacaaacaataaaagtgagctcattatttttttttcctcccaattctgtttcctttgacatttatatcaacattcactctgttgtctaaatcaattttggatttacctttgatttctccctcttacttaacactcatattcaaacaaatctttgtgctttatttattcttcatctaaaagtacttcaaaatctatttccttcttcattgtcatctcagtttaaactctaccatccttccacatgggattatgaatattgtctcccagccaacttctttgcctttctcttttgttgaattaacttttgatgtctactttttttcaaattttgaggtaagctaattttattcttttttaacataaattttattatgcatatttgaggtttataacgtgatgttatgggatacatacagagggtaaaatggttactctagtgaaacagattagcagatctatcatctaacatagttactctgtttatctgcttctaggagtcagaaaacatatagttacttttcattcattcattcattcattcattcattcattcataatctactcatttaatgagaattcttagtacaatacaattttattaatcatagttgtcatgttgcacattagatctctagacttgcttaatcctatatatctgtcactttgtgtcctttcctgtatctcccctttccccactcccttgtgcccttaataaccactgttttattctatatctctgtatatttgtcatcttttttttccaaatattccacatataattgagatcatgcaatatgttttctgtctgtgtttggcttatttcacttaacataaggtcttctggggtcatccatgtcgtaacaaatggcaacgtcttccttttaaagtattacccatggtttccagtttgcttccatatctttttttttttttttttttttgagatggtctcactctatcacccaggctggaatatactgatgtgatcatagttcattgcagcctcgacctcctgggctcaagcaacactctgacctcagcctcccaagtaggtgggggaacaaacatgtgccaccgtgaccaactaattttttattttttgtagagacaagatctccctatgttgctcaggatggtcttgaactcctaggctcaagtgatccttttacctcagcttcctgaagttctgggattatgatcatgagccaccctgcagagcctgtttccgtatcttggctattatgaataatgttacagtgaacatggagtgaagatatctttgtgaggtggcaatttcatctcctttatgtatatacctggaaatgagattgctgagtcatatggttgttctgtttttaatttctttagtaacctccatactgtttttgataatggctatactaatctacattcccgccaactgtgcactgggttcactttccaactgggttcaccttgccaacacttattgcttgtcttttaggtcatagccattctaccaggtgtgatgtgattatatcctagtgattttaatttgcatttccttgataataaatgaaaatgaggccaaaatgaaatgttgggcattgttatgtcttctttggagaaatgtctgtttaggtcctttgtcccttttttccttgggtcatttgattttcagctatcgggttgtaaatgatcttaataaattttggatattaatcccttatcagatatatagcttgcaaatattttttccacatttgtagattgccttttcattttgttgattgtttcatttgctgtgtagaagatttttagtttaatatagatccatttatttatttttgtttttgtagcttgaaatttactttttcctttccaatttggatgcttattgttattattttatcatcattattatcaattaattaattttcttatcttatatctcttgctagcacttccagtactatgttgaatagaagtggcaagagtgggcatctctgccttgtaccagatcttgatagaaaagtttacagttgttccctattgattataatgttagctgtgagattttcattaatagcttttattatatggagaaacttttcttctgtaccaaaactgttatgtgtttttatcaagaaaagatactgaactttgtgacactttttttctgcagctgttgagctgatcatgcttttatttttcattctgttaatgtgatatatcacagtgactgatttgcatatattaaactggctttgcatgccagggatatatcacacttggtcatcatgtataatttttttgacgtgttgctaaattagttttgctagtgtttcattgagtattgttacattaatgttcattagacataatttttttgctgtgttgctgaattagttttgctagtgttttattgagtatttttacactaatgttcattagacatattgacttccagttttcttttcctgtgggatctttctctagcttaagtagaaaggtaattctagccttgtaagatgtttttggaacatcccattattttgggaaagagtttgagaaggattggcaataattatttgaatatttggcagaattcaaccatgaagtaatctggctctaggcttttctttgtttaaaagtttttaatgtcttcttcaacctctttattgtattattggtttgtttaagcttcctattttgtgttgattcaatcttggtaggctgtattttttttctagaaatttgttcatttcctctaggttatcaatatgttaacatataattgttcacaatagccgattatgatccttcttttttatttctgaggcatctgttataaggtcttcactttcatttctattttatgtacttgagtcttcactctttttttcttagtctagttagatgttttttgattttgtttactttttcaaagaaacaactcttggttttattgatttttttgttttatttttctgttctctatttgatttatgttctgatcctttttattccccagttttattttcctttttcttttttctttttttttttttttttttttgagatggagtcttactctgtcgtccaggctgttaatgtggcatgatctcagctcactgcaacctctgcctcctggtttcaagcgattcttgtgcatgcctcagcctcctgagtagctgggattataggtgcttgccaccatgccaggctaatttttgtatttttagtagagacagagttttgccatgttggccaggctggtcttgaactcctgacctcaagtgatctgctgcctcagcctctcaaagtgctgggattataggtgtgagccaccgtgcccagcctattatttcatttcttctgataaatttgggtttagtttcgcttcttcactggttcctagaggcataatatagggctatatatttgggatcttttttttttttttaagtaggcatttcttgctataaagattcctctagaactgcttttgctatatcccataggtttttatatgttgtgtttctattgtcatttgactcaataattttttgttaaattctcttttgatttgttctttgaccaattggttgttcatgagcatgttgtttaaattctttatatttgtgaatttaccaagattccttctgttattgatatctagtttcatatacttatagttcaaaataatactagatatgatttctatctactcaaattttttaatacttgttttgtggcatatatggtgcattctggggaatgttccatgtgcacaagagaagaatgtatattctgctgttgttgtatggaaacttttatacatgtctattaggtcaatttggtcaaaattgcatttcaagttctatattttctcattgattttctaactggctgatctattattaatagtgaggtattggcatccactagtattattatactgttgaaagtgaggtattgaagttccctactattattgtattgttatctatttattattttatgttcattaatattggctttatgtgtttaggtgctttagtgttacccactcccctacaatttatacttttgttgtcacaatttacatctttttatcatatatttcttaatagcttattgtagctataattgtgaccattttgacttttaaccttcatagtagacacttgaaatatttacacattgtcattgcagtaatggaatattctgaattttactataaatttatttctatcagtgagttttatacttttatatatttccattatagtaattataatccttttatttccaattgaaaagctaaacattttttgtaaggcagttctattggtgatacatcttctgacattttgcatatctgaaataatttgtttctccttcatttttgaagaacagctttattggctataccattttaggttggcagttttcttctttcagcactttgactatcttatctcattcttttctgacctgtgatatttctgctgagaaatcactgatgatctgatggggattcccttttatgtcacttgacattttcctcttgctgattttccaattttctctttgtctttgacttttgacattttgattataatatgcctcagtgagcacccctttggtagaatatgcttgaagacttttgagcttcatggatctgtatgttcatatctctcacccaacttgggaagtctttagctattattttgtcaaataagctttatgtgcctttttccatctctttaccctctgaaactctcataatctgaatatttattcacttaatggtgtttaataagtcccatagactttctttttcttcactctttttcattttttttctctccgggttattttaaaagatctgttttcaagttcagacagactttttgctgcttgatctagtctgctgttgactcttacatgtacttcttatttcattcaccaccttcttcaactcgcgtatttctgtttggtcctttcttatatctatctctttcttaaatttcacaatcagattatgaattattttcttgatcttactgaattgtctatctgtatcctcttgtatatcatgaattccctttatatgattatgtattcatcttcaggcaatttgtaattttcatttatatggggttagctactgaggaactgttgtgtttctttggtggtgtcatgttcccttgctttttcatgtttcttgtgtccctgtgttgatatctgtgcatctagaggaacagtaactacttttaattttatagattgttttttgtaggaaaaaactttcatttgcagatgggtcttagggtgtcatttggacagggtccattgcctccagttctgtgtgagtgcagtggtgtagcctttgtgtatcttcttcagctgtgatcaacattattgataactgcagttgcctcagtggtctacactgtaggagtttgtggcagcgtagtggcagggtaagttgtatggttcttggtgataagggctttaggggtcttcctgtttatgtttacccacagtagagagactcagctgaggggatccctcttgctgtctggtttgacatgtcccataggcagccatagtggtgctgtactacaagacacaggtactcagagtggctgtagagctgagggcctgggctcaatgtcttgtttcattactataacacctgtgacattgatgcaggttcattctctgaggtgcaggtgggtgctgcagtcccactaagctagggtggtgactcttaggcactcctcagtagcttgaaaccaagagaacagggaggtagttgtgactctggtcctggggatcaaggtgtaatactgacatagctctagggaagaattggtgttctacaggcttagtacttatggatccagccatagctgcaatttagatcctggaagcagtggaggacagagacattttgagcactgagagagggggtactgtgtagtggtggctccggaccctggagtgctaggacatagccgtggccaaagccctgcaaggttggctgcatcagcagcaataacccaggaatgttggggcacggctgtagcttggactccggggagtagggggcaatacaaaggtatcttcattgcccatggaggtgagatgcctcagcagttcagattccaaaaggcttgtacagattcagggaagcaaggtgctgaagctcttcagcccagaggacaaggtaacccagctcagccaaggctctttttccctggggggaagggtgcctgttaactcctgttccagggaatacagctgctctgctggactggggtccaagcattagattgcttcaggcactgagcgggtattgctgttcttccagcttggcaacagtgtctctgctgggtgggagcacatgattcttagggactgagtgctgcatgggcttggatgatggaattgtgactgatcctctggactaaagctcaaattcctgagggacaggacactgggttggtgtactagtccattctcaaactgctatgaagaaatccctaggactgggtaatttataaaggaaagaggtttaattgacttacagttctgcattgctggggaggcctcaggaaacttacaatcatggcagaaggcagaggagaagcagacaccttcttcacagggtggcaggatggagtgagtgcaagcaggcaaaatgccagaagcttataaaaccatcaggcctcacaaactcactcattatcatgaaaaaagcatgggggaaccgcccctacgatccaattacctccaccttgtccctcccttgacacatgaggattacaattcaagatgagattttgggtggggacacaaccaaatcatatcaattgatttaggtactgaggggctgtggctgctttctggctcaagtatggcttcttggctgggcaggagtgtctggtcctttggtggcagggcaccacatgggctcaggcactgaggttacactgctctgtggggtcaaaggctaaatttccgaggagtggggcagctggttggttcagttgctgggggagtagctgctctcctgagcctaggctctgtgtagacaggggtggagctcagcagtgactgggatgcgggggagggattctctcctaggcaatgtttcccaaggagaaggagctgcagcagtttaactggggtctggtacttttccctgtacgagaatgtggtgtaatggtagtagagtctcagggatgaaagaatgcagtggctacttgttcctggggcagggcatactctatcaagggctccggtttcaagattgtgatgcacagtagcagcacggaccacagggggtggggtgcaatgtgagatcttttagagtagtgcagccatgtgaactccaggaaacaccctaagctgggcttagaacctgtgaacactgcagggtttttcagtaacaaagattataggtatccactgtggtgatgaaggttgctaggggcctcctccttcctgtttccatcatggcagaaatacttcctgtttctgagctgattttagctgggggcatgagtggcagagtcaaggctttctcgtcttatctctatgcagcccttctgagtttctgtgatccacaggggctcttcacggacctactctacttcagtgctttcctttagttgctctgaccaaaatatagttattcatttgttgttttggtaactgttttggtggagagggatgagagttaggcacctctagtgagacatcttgatgatgtctcaaaaactctatcttcctattgttctattttcaagtttgctaattccttgtgacatattttttctgctaagttcctgccggaagttttattatgattattatatatttcatttccaaaattttaatttccttattcatgttttctatttctttagttactgaaattttctattctttttttttattatactttaagttctggggtacatgtgcagaaggtggaggtttgttacataggtatacatgtgccatggtggtttgctgcacccatcaacagtcatctacattaggtgtttctcctaatgttatccctcccctagccccccaccccccgacaggccccggtgtgatattctcctccctgtgtccaagtgttctcattgttcaactcccacttatgagtgagaacatgtggtgtttggttttctgttcttgcgttagtttgctgagaaagatggtttccagtttcatccatgttcctgcaaaggacatgaactcatcctttcttatggctgcatagtattccatggcgtatatgtgccacattttctttatccagtctatcattgatgggcatttgggttggttccaagtctttgctattgttaacagtgccacaataaacatatgtgtacatgtgtctttatgatagaatgatttataatcctttgggtatatacccagtaatgggattgctgggttaaatagtatttctagtactagatccttgaggatcaccacactgtcttccacaatggttgaactaatttacactcccacccacagtgtaaaagtgttcctatttctccacatcctctccagcatctgttgaggatatttgtatttgcttgttgaagaacttttgttgacaaataattctaacattctgtcatctcagcattgcgcctctttttttttttcttttctttttttttttttttttggtcaatcaagttgtgatttcctgtctcttgctatgacaagagctattttattatatcttgtacattttggctggtatgttgagagactctggatcctagttcagtcttttatttcaacaggcagttacactgtttagcttaaccatgtaaatactgatctaattttctggccaacagttttaatgacagtttaattttgagatactatttttatctgcttaattggcctgattctattaggtcttttgctaatccttcttggtgccaccagtgaggaccaaaagtgcttccccaggcagggttatctccattagctaggctctggaagagcacttttcctggccccttgttttctgtgggttctttcctgattcctgcctcagcattcaggcatcatgggttgctcagtgtctggtgtaagttgtaaaggttggggaactttagtttccaggcacttcccttggcctcttgtaggcaggattccatttcaataaagggaggaagggtcctgcctgagctgctttttcgtactgatttgggaattataagatgcccatgctgtatctctttgtgctggtgtgggagttggagcaagaactggaagatgttgaggcacagtgttttccttcaatcttgcaatccttaaccagtctaccttcctctttccacatctcagagtcctcctatggttgtctgttgtgttatctttaaggtttataattgtacgtagaggagaggaacaaggaatgatgagtctatgccatctcatccagactgcctttcaagggtatctttctttctatagctcaagttcttattactctctaatttaaattattcagttaattcccatcactctcaagtaaaatcaatacttcttaatctgaccttatcaattaggaccctgtgctacatgtaacagaaaccacaatccaaataataattaatgaaacctctatcttggcttatatctgtaaagctcagagtcttcaagggaggcctcatgccaggcttaaaccatatcaccagaatccatcactagtctgctttttctgattggctctctcatagtgtttataaaatatttgccacatttttcttggggtcagcttattcatgttcataccccaaagcaagaaaaatatatgtagaccctaacacatcccacccttacacaccaagcaagaaggctaaatgtcatgggtttcatgaggtaactttctccatatttgaactctaagtatgtggtggggtcagggaaggcatcttcttactcctgtttcctgaagagtgtgtagtagtcaatatttcctgaagcacatgggccgtaaggaagtaaaaattcagttcctgttatttaaagaaagggaaaatgggtccatcaggaccaaaaaaaaaatcctgcaaatgtaattacagtggtttacaagtactgccttcatctctacttgtttgctttgctactttccactcgtccagtgtatctttttgtgctcccaagaaaccattgagaagcactttcagatttttagatgtatcatctttttccaccttgaagactatggtcatgctactctctttgcttgaaacacccaactccattcttcttcagtactatggtttgaatttatccccaaaattcatgtgttggtaacttaatccttaatgcaatagtgttgaggtttttaaagagatgattaagtcatgagggctctgcccttacaaatagattaatgcagttatcaagggataggttagttctcacaggattgggatcctaataaaagggtaagctcagccccttcccttgttcctctttctcctgcatgtgctgtctcacccttcaaccttttgctgtgcaataatgtagcaagaagggcctcaccagatgcaggtcccttggccttggaatttccagcctgtagaactgtaagaaatatttgttctttataaatatttatttatatttataaacagaatacctagtctcaggtattctgttacctcagcaaaagacaaactaagaccaacaactgatactgagtagcgagactgttgttataacaaatacctgaaaatgtggacacagctttggagttgggtaatggctacgggctagaagaatttgaatgagcaagctagaaaaagtctagatcatcatgaatggagtgttaagggcaattctggtgagggcttagaaaaagacaagaactttcaacagcttaccaaccaaaaagagtccaggaccagatggattcacagctgaattctaccagaggtacaaggaggaactggtaccattccttctgaaactattccgatcaatagaaaaagagggaatcctccgtaactcattttgtgaggccagcatcatcctgataccaaagacgggcagagacaaaaccaaaaaagagaattttagaccaatatccttgatgaacattgatgcaaaaatcctcaatgaaatactggcaaaccaaatccagcagcacatcaaaaaacttacccaccatgatcaagtgggcttcatccctgggatgcaaggctggttcaatatacgcaaatcaataaatgtaatccagcatataaacagaaccaatgacaaaaaccacgactatctcaatagatacagaaaaggcctttgacaaaattcaacaacgcttcatgctaaaaactctcaataaattaggtgttgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaaaaacaggcaaacagagagccaaatcatgagtgaactcccattcacaattgcttcaaagagaataaaatacctaggaatccaacttacaagggacgtgaaggacctcttcaaggagaactacaaaccactgctcaatgaagtaaaagaggatacaaacaaatggaagaacattccatgctcgtgggtaggaagaatcaatatcgtgaaaatggccatactgcccaaggtaatttatagcttcaatgccatccctatcaagctaccaatgactttcttcacagaattggaaaaaaccactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgctgcgtatctacaacgatctgatctttgacaaacctgagaaaaacaagcaatggggaaaggattccctatttaataaatggtgctgggaaaactggctagccatatgtagaaagctgaaactggatccctttcttacaccttatacaaaaatgaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaaaggctaatatccagaatctacaatgaactcaaatttacaagaaaaaaacaaacaaccccatcaaaaagtgggcaaaggatatgaacagacacttctcaaaagaagacatttatgcagccaaaagacatatgaaaaaatgctcatcatcactggccatcagagaaatgcaaatcaaaaccacaatgagataccatctcacaccagttagaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgttcatttcatcactattcacaatagcaaagacttggaaccaacccaaatgtccgacaatggtagactggattaagaaaatgtggcacatatacaccatggaatactatgcagccataaaaatgatgagttcatgtcctttgtagagacatggatgaaattggaaatcatcattctcggtaaactatcgcaaggacaaaaaaccaaacaccgcatgttctcactcatagatgggaattgaacaatgagagcacatggacacaggaaggggaacatcacactctgggggctgttgtggggtagggggaagggggagggatagcattaggagatatacctaatgctaaatgacgagttaatgggtgcagcacaccagcatggcacatgtatacatacgtaactaacctgcacattgtgcacgtgtaccctaaaacttaaagtataataataataaaaaaattaaattaaattaaattaaattaaaagaaaaaagaaaaagacaagaactgtagcgagagcctacattttcttaggagttacttaagtggttgagatcagagtattggtagaaatttaaacagtaaaggctactctgacaaggtcttagttgtaaattaggaatagggtattgaaaaatggagtaaataccattctttttataaagttgcaaagaatatggtggaattatgtctgtgtccttggactttgcggaaggcaacactttagagggatgaactaggacatctgtcagaagaaatctttaagcagcaaagtgtttacagagctacgtgacttcttttggttccttatagtaaaatgagagaagagagaaatgattaaagatggaatttgtaattaaaaaggaaacagaatgaaaagatttagaaaactctcagagcctagccaagtaaagcatgtttgagagagaatattaatagtgtgacaaaggtgtttgctaaagagatttatatggctagaaaaacaccaggttctgtttgtcaagacaatgggagaatgatcctaaggcatttcaggtgtgcagaatgcaacagctgtagggccatggcgatctactcctaaatttaaatggatgttgcgaagaacctgtgagccaagacagaggcttgtcacagggatggtgccaccccggagagcctccactgaggaaatgtccagcagagccataggagtgaggccactacataaactccttactctcataatgtttagtggagccatggaagtgaagtagaccctgtgaccccagaactacagagcaaccaatgtgcaactgcatcctgggagagctgcagccataagactctaacccattagtgctgctgggtggactgagccaaacaaaaccctagggacagggcttcatgaggatgtggggtcccactgccttcccattgtgcccagatgtgagacaagagctcaacacagattattgtctagttttaagacatgatatggtttttgttgttgggtttagtactgacttggggcctgtgatttctctttttgtgcctctctctctctcttttaaaatgggaatgtatatcctatgcctgcccccccattgtgttttggaagcatgtaacttttttgatttcataggctcacagatggaggggaatttgcctgaagataaatcacgccttgagtatgacccatatctgatttagatgaggctctggattttgaacttttgaggtgatgctggaaccagttaagactagggtgagataaaaagaatttattttgtgtgtgagaatgacatatgttttccaagccagggggcagcatgctattgtttgaatgtgtcactaaatgcaaaggtgttgagaaaggggacctttaaaaagtgattatgtcataagggctctgctttcacgagtaggttaatgccatcattgcaggagtgggttagttgtcatgggaatgggtttctgataaacagacaccctcctctgtctctcatgtttgtgctgtcttgcccttccaccttccactacggtatgatgcagcaagaaggctctcgctgtatgtgggccccttgaccttcgactttatagcctccagaactgtaataaataaatctctgttctttattacccagtctcaaattttctgttattatcagcacaaaacagactagacatgcagccattttccctctagacacatgcacacacacctatgacctatgtcttgtattgtttcttatgcttctgcattcatttcaatacttgctctgcaactctctcttacactcaaaactaggtgatgccctactgattttacagcctcctttacttctttcaccatcacacttattataccctactgcagtggcctggttttagctgtgtatcccactaacttacaagaaaagaattgtgtcttaatcacaacttgacccttattacctaacaaagagcctcttgagtgatccactttaaaaaactctaggcgatcatatcatgctataagtacatgaagaaaagaacaattataatgtttaggtaaacaaggaggagcctttgtagtaggtgaaccttgaaaaaggagtagaaattttccaggtcttagtttcaagaaggcatttcaggcagtagaaaggtatttcatggagacaggcaagtataagagatataccacctgttaaaatgaaactgaacagatccccgtccccatgggcgttatccatctgtgccttcaaatccatgctgaggctgcttctgcaagcttaagaaattggtattttgcagatccctggagtccacatgacattgtctggccttgtttgttactgctcttttttcagtgtgtaggaatgaagaatgagtgccaataaatctgaatgtcaaaagtcaaatacaaatgtcaaggccattccacatcactggttgttttgaattctgagcccaatttttgcaggctactatggtggggagaaccacttggctatgtctccatttacttatcaaaggctactccaggcataacagacctaggctgcaggcaaatggccttcttatgccatacaagcacagactaactcatcaaatgaaaaagaatagagtttgaaattcctttatgagttttaagaatatttcctgtgagagaaattttgaaagctgctcaattaaaagcaactgtacttcatatattttattttattgtgttgttggcttcatttaggttgaaattagggaatctagcattgttattggtgtttacttttttgagaagtagagcaactcaaattattcagcaggagcagaagggtttggttgatcctatgttgtatttatgccttatatggtattttaagatcttatacaggtaaatagaatcacataaaggtaagaaactaccggagctgtggctcatgcctgtaatcccagcattttgggaggccaaggtgggcagatcacctgaggtcaggagttcgagactagcctcaccaacatggtgaaacaccatctctactaaaaatacaaaaattacctgggcatggtggtgcatgtccgtagtcccagctactcgggaggctgaggcaggagaatcgcttgaacccaggaggaggaggttgcagtgagccaagactgcaccactgcatgccagcctgggtgacagagtgagactccgtctcaaaaaaattaaaaaatgaagaaaaaataatgaaaagagaataaactatctcctttgagaagacaaaggagaaaataagatatattaagctccgagtttgaatcaggaacttaaaaaatatacatatgttattttatttaaccctcactggaagcatgcatatttgcccaatgcctaactttatcaaatgttaatactctgtctcaaaaaaaaaattttttttttaaatcataccctatgtggtcttttgtgcctggcttatttcacttagggtaacgtattaaatattcacctatgtcatattacatattattctttgtattgcaaaataatatcctaatgtatgtatacgctacatatttatcagtttataaacatttgggtcattctcaaatttgtgctatgaacattcatgtacaagttttcatgtgtttatgtttttatttattttgaatatatatactcaaaaggaatagagtgctgggtcatctggcaactccatgtttatcattttgaagaactgtgaagattttacatttccaccagaaatatatgagaattcaattttcttcatattcttaccaacactttttgtcttcttgttattttagtcattataatattcaagaaatggtatctcactagggttttaatttgcattccaataatgtctaatgatgttgaccatcttttcatatgtttgatgaccattttaaaatcttctatggagcaatagctattcaaataatgtgtccatttttaaatgagttctttacatttttattattaaagttgtaagtgttctttatatactcagtggacaagtgtcatattagaaataaaatttgcaaatattttatctcactctatgtatcttctttttatattatttgaagtttattttgcctgatattagtagagctacttgagctctattttggttgatgtttgcatggcatatcatttttctatccttttaccttcaagatatttgatacatataatctgaatctgaagtatatctcttgtagatagcataaagttggatcatttttaagtccattctgctaatatctgccttttattggaatgtttgacacatttacatttaatgtaattgttgacaagtcaggatttacttctgcctctttgctctttgttttcaggcattatgggtctttctttactccctattcttctatcacagccttccttagtattaaatgaatatattaaaataccattttaattcccttttttttttaacgatgtaattttaaattttatttttgtagtggtttccctgtggattacaatgaacattttcacttaaaacaatgtaggaattcaataaacatttttacttaaaacaatctaggattgataacaacttagtttcagtggtagagacaatctttgctcatggatagttccattttctcctccttttgcactgttatcattagcatatgcatatgactttatgcatcataatataatcaatgaagtttttatgtattgcttaatgtagctgccctttaaatcaaatgggaaagaaaggggcttacaaactgtattgtctctaatatttatttatgtagttatctttatgggtaccctgtttcttcatgtgaacttagggtactgtccagtgctttttctatttcttcattttagcctgaaggacaccctttggtatttcttgtagggcaggtctgctattaattaatattctctttatttctctcatagacatacctttacttctccttcagttttgaaggacagtttcgctattggtttttttctttcaacagtttgaatatgtcatcccaccacatcgtggcttctatggtatctaataggaagcctgctactaatctcgttggaaatcatatgcgatgactccttttttcgatacctttacaattctctcattgtatgtgtgttttgacagtttaattatgatgggtctaagttattatgtcttttagtttatcttacttggaggtcattgagcctcttggatgtatgaattaatatttgttaacaaatttggggaattttcagccataatttcttcaagtattctttttgccttattttctttctcatccttctaggacttccattatgcatatgtcagtgtgattgatggtaccacatagtctttttgaggctttgttcccttttatttatctttttttatttctgtttctcaaaccataaaatctcaatttagctatcataaattcactgtttttttccttctgcctgcttaaatctgtttttgaacccctctagtgaacttatttcaattattgcccatttcaatgacacattttatttatttattttaaaaataatttctatataattattaatattctctgtttaaggtattattctcatattttatttaattatttagatatgaagtcctgtagtttgttcaacatattatgatacgttaaagtatgtttaactgacttaaagtttttttttattaacatcaatatatgtatgggcatccttggagagactttaacttactgctgtgctttccttttccccttcctgcccccacatgggtttacttttatgtttctttgtgtatcccataatttttattgaaagctgaacaatttaagtaacgtaatgtgacagctctgaaaatcagattcacctccacttgccaaagctcttatttgattactgatgtttattgctgttttttttttggtttttttttcatttttggtaactttcctggaataattctgtaaagtctgtattccttatcatgtgcagccactgacatctcttttccattaacttagtggtccactgatttctacagagattgccttaaatatcttcatcaagtagaactctcttcctttgccaaatattcacatttgtgctggggcaagccttcagtgctccagcagtttacaactctgtaattaccttcacttcttggtttttcaggattcaagatcagacagaggtgagagagtagggcctgctgggatctttcctacccttgtgcacaactctgttcatgcgtataacattgtgaatccctgggaatatgtagagattttcaaagcccagtaggaaatattattccccatattttcatcttaagctttttgacaagcttcttgtttgccccaacttgctttgctgcctcaggcatcagccacgttaaacaattgctgctgattgcttcaacaaactctcttatgatagggctttcctccctgaatgagctttaagtcaggtcagataaagtttaaaaaagtgacagttcttcagtttggaacttctgaagatctccaaactctacctcttccagtgtttagtggacttctagtttttactgcttttatggctgctagattgttaaattttaaagttcacacagagctggggaaagggggatggaaatagagcttaaaatgatacaaagcttgctggttttgttgttgtcatttttaccaaggttctgccttttttcttctataaacactccttagattgttacaagcctttggtttatttctagagttcttaaaaaaagttgattttttttacaaatgttacctatctttcattgattttatggagagacagatgtttggagggacttactttatcatctggaagtaattagatgtttggagggacttactttatcatctggaagtactcttcttcattgataggtcttaaaagttttggcatttcagtacaacatagatttatgtgaatttatctttcattattctgctgggtactcaaagggaattttaatttgtatctttaattctgaaaaattttcaccagttttatcttcaattattacgtctttgttattccttctgttcaagactttgagtcttattttgtttcctgttggagcttttaatctattcttcatctctattaggtgttatttcaatgttttttgtcttggtcttgctactgcattctgagttaaattttaaatattgtcttccagtttaacaaactcttctatattgtgactagtttttgaaatttttaggatgatttaattatttttttattttaattgagggtttttatttatttatttatttttttgacggagttttgctcttgtagcccaggctggagtgcaatggcatgccctcagctcaccgcaacctccacctcctgagttcaagccattctcctgcctcagcctcctgagtagctgggattttagacatgtgccacaacgcccagctaattttttgtatttttagtagagatggggtttctccatgttgtttaggctggtccgaactcccaacctcaggtgatccgcccacctcggcgtcccaaagtgctgggattacaggcataagccaccacagaggttttttgtttgtttgtttttttaatcctaccaataaactcagagttttcttctctctctttttttatttttaacaatctcttgggttttttattttggtttttgaaaatgaagatttaaaaaaaatttctctcctgaaacattcgtctgtaagttttaaaatgttgatcattccatctggagtaattcttctgtgtattgtttgtgatggttgtaattttaacattaaatttcacatgaattttggaatttggatttgctggctcatttttgagtgggagtttgttgtgtttcattttacttttcctctctgtttatgcttacttttttctccctaccatttcttggctcacattaaataatgaatcactataatgtaattggacgtatctgtgctgagacagtattagggagagggtagatatggtcacccagtcaggaagcatcttattgtctcattttaagtctctggctgtcatctccctaggcctgcagctaccaggaactagaaatctgaaaagtgttcagtgacatctctctacccccttatttattctggggagatttaaaacttaagccttctcagatccaggtgtcattcagaataaggttatgttgcaatagcttataaccctaacatctctgtggcattaaaaaacaacaacgaagtttcatttctcactaatctttaatgtctgttgtgggtcctgtggctatgtcttatcatcacttttattctgtgactgagatagatgagattgtctcttcctggatcaaaagcatatgggaaaactgatcagtggcttctaaagcttcttccacaaggcatcatatcatttttgctcacattccatagactcgaacaagtcatgaggccaagcctaacattaataccacaataaagtagattctgccccactagagggttaatattttatattaaagtataatatggtctaccaaattctctttcacttattttttttacctgtaatagtgtaacctttagctaccactgtctgctttgattccctcaaactgcctgaactattgcttcagctgtgaacaacactttctatttctattctattctgtgtacttgttttcttgattttagcccaattatctctctgattttctatttttctctttgtgtctcattgttctatgtttggagcataggaaggtgcctcagataataaattaaatatcctatctcattcataatggcatcaattttttttggtggaagaaaaacaaacttcacaaatccataattaaatctcctctctctcccacaaatcaccttttggaatcagttttagtatcagactagggaaccaacatcctctgtgtctggtatgagatgcaatctttatatttctttaaggttttggtgttaattgatccagtagaatttttatgtaaccaaaatttattccttggcctgaaatgttctctaattagttactataaactggtgcttattcagccgagctgtgcaattttgggacttttgggttaataaaagcctaatctgctcatttgtttacactgtttactccctaaaggcttatgctttgtgactgaaaacaatgcttaataagcagaagaaagcatgttaattgtaggcactgccatgctgctgtgtacctaagagctgggcttggctgcagctcaaacaggtcttgggtagaactaaccaagttgccctcaagcttaacttccaattgtcacaaaattcatcttgggcttagagatgaattttaaatacatcgaagagtaaaatgctctgttaccagagtgggtcagtggagctcagctaccatcgatctacactctaactctcttcctccatcaacctttacatcctctaatggaggaatgtctcccatatgaaatagtggccactcacccaaatgtaatattggtgacagacaaagggaaactaagctctaacctctctccccaccaaaagttcacatttcttcagtcaaatcatcatgtggacagaaatcaatttcttctctatgctgtcactgagaaagagggaatatataaaactcacgtataaaaatacagaagtaaaatgaagatctctatgttaagtgagtactatccagaataattgatttccattactggatatcttcaaataaatgattgatggtaatttgatatcacaaaagagaaagcagtattttttataaaaaagctttattggtataacagaggtataatgacattttttaaaaagttacacatgtaatgtatataaccttaatgagtctggacacttgtgatactgttaccacaaccaaggtgtgaaacatatcatcaagaccacagtttttgtgtatgtgtgcacattcatgacaggatatgtgttacagagctaatgtctttattttaaaaagctttattcatttggattttattccttactattatattctttattcaacagttgtctttccatctcatctctcctgattcttccccatgctttaaaaaatgttaatgtcttcttgagactgtcaaaaacaacattacaacaaatttctttatagatctaattggcttttataggtgatacatgaatcagggcagccttcattctacaaaactgaacaagtgttcttctgggcaggggcaaaacactgggttttgaaaggtgaaaagtaggaaatagaaaaatggaaatctagtaagcatcatattacctcaggttactttttttaaaggggtaaagcagaagagacttccttattaggattactgaggtaaactggaatctcttgttttcaggaaagattgttttgtttggggatctatctgctttcttaaattttcattttaattatgtggcatttagcatgagtgactccattttggtttggtctggtcgtttagggcctagtgcaggagttcagtctgaaacaatggcctcccataatcttgtttaacaattctaaaagaaggtcgttcctttaactctattcctctctgtggtttcatccctctcctttaccaatcgattcatatttacttttgtatgttctcaaaggcaagttaaataatactgcatactgaagtctgttcagtgtccccacaatcataataaaatgtctaagacagacttatgagcttctcaaactgtgttgtgggtgtacttttaggctcatgtgagatcatgaatatggtgcattctcctgaagtatcaattttactcagtactgaaaacattattctatcattaaaacaaacacaactagattagagagtatattgcaaaatctccatgaacttaatactaaaataagagtctgaaagccgactggtaccccagattgtcaatcagctcctattggaagcctgtcaagtccaccatagagcagcagccaaaccatttcatgggagagaacgaggactctgcagcgaagtctgaaagtgctgcagccctctggaccctgtggactctcaaaactaatcaaatggaatgtccatccaagacaaagccccgcaccaatgtgaaattgttgagagaaaaccaaaatttatcaaatagctacaatagaagcaaaggaaataaagtggtaaagagagagagagggggaggcaaagaaaaggaggaacaaaagcagcattaccacagtgaatgtgaattttaaaattattttctcatttattattttgcaaaaatgacaggagagggagccctagagccataatgctagaaaactatcctgacccttcctctttcctaaaagtacaaagaaactccaaagaagaaaagaggagaaagatgaggaggaggaggaagagaggagaggaataggggtaaaaataaatcttggtcaactcttatacaaacttattataaattcttacagggaaggagaatgaaaacagaatgatgcagacaaggaaattatgccataaagctagtcccaaaacaaatgaaaactacaacctaatattttttaaaaatagctaaaataagaagctatgaaaaaaagatgtataccagaattagaaaaactctgaaaagaggcaattagaaaaattaagatctaaaaagagaagtaacaggacaaatttagaaatgaaaatgaacctttttacaatcagtcttcatttttactccattgcgttcgacactgttgttctgaaagtctttcctgctctggactctggaagatgttagtccttctaattctcctgcagctactgcttcctgctctaattcatggctcttcatcactgccatagaaatgggacgtttcctatggctctctctgggccacatctttcagttaacttggcccagtggctgcaacaacttttaaagtttataaataactttaaatatggctgcatttcaaataaacccctcacttcttgacctgctccatacttgactatccaggtgcctttgggatgtctcactggcatttcaggtgggtcatgtccaaagtcacctactcagtgcttaaatctacctctcatatacaatttcataatttggaaaacaatgttttttttctgtcactcagattcaaaactccagaagcatccatcactgctttcttctttgtcatgttcattatatcaaatgtccttgtttgctcatgtctgcccccaaagtacctcgaatctgttctctcctttaactcttcactgccactccctcaacaccactctctacttgcaataaataactgttttttgccttctctgacttcattttgtctcatctgctagtgatgttgtcaaactgatctcaattggtagatcggagttgtcttctaggggagtttatgaatgtaaacaaaactgtgaatgtggcctcctgaagttgcatatttgacctggctctgtcttcttcagggcaacagattctcaacctggttttgttgttagtacagttgaaagaattaattttaagaaaaacaagtcagaagaaattacagtgcagtaactagtaaaataatcatgactacattaaaatatttttaaatacccttaaaatggttcaaggtattatcctctagaagtgtattgctatttattgccttttcaatactcttttgtatacctgaggcaatgtctttgagaacctacttgaaaaaaagtgtaacactgttttcctcttactcacagtaccttgtaccctgatatttgtaacatcacaaaacccacagagttaggggctgaccaaatatacacagtaagttatagtattgggtaaatgaaacaatcctgcaacaaaagattcttcagttccaatacagaagaataaaggaaacacaatttaattttgagaaagcattaccaggttgacatgtatataaggtggcacacaagaaactataaactctggacagaatcttacacaaatctatacagcagtcaaagaaagaacaatagaaacttctcttatctccttgagagataaatagatgagccctgtcatctgctctatagttgtgagatagcacagagctaatttgtaggtttacagttccaaggggaagaaggccagaaaactgaatcaaaaggactatcttgtttgggggtttattaagtttacaaggaaacaccccaaaggaaaaaagcgtgagtatgaagccacttctctcctcaaagaaaattttataatttatttttacagttgcaactacaatcacttgtaaagacaaatcccagattccttagaaactagaagcatagtaatgaagagttctcgaaacatctgcaagctactgtgtataaatggaaaatcactgggctatagagagacggtcagattttttgtgtgtggaatttttaatgcattttgtaatctcacatcaacttgatttttactcacatttcccactcctacatccttatctcggaccccttgggatatagagaaggactggctgggctggagtcagttggaatgcagacagtggtaggtcacacagaggctctgcaggtgactgggagatactcaaggttcataggataattggatgtcagtcattctgatagtggaattcaatgatatagaagaggattatttagacaatatgtagtcaagcagtctgccaataatttattgagtacctgctatatgccaggggctagataatttccaagaacagagtatatcagcatgatagagttctaacaaaagatgctgagacttattggtgcggctgtatatctggagaagagctccggtgtctagaaaatgagagaggtaaagagattttaccctaggctgggtgcggtggctcacacctgtaatcctagcactttgagaggccaaggcgggcggatcaccgaagtcaggagttcaaaccagcctggccaatgcggtgaaaccccatctctactaaaaatacaaaaactagctgggcatgttggcttgtaccagtaatcccagctactcaggaggctgaggcaggagagtcacttgaaccggggagtcagaggttgcagtgaggtgagattgcgccattgcactccagcctgggtgacaagagcgaaattccgtctcaaaaaaaaaaaaaaaagacatttcagtctaacgtaaaggaaatctctctagaaactggagtattatgtaagagatggtcttttgagaaatacaggcagaagccatgtagcatttgttgacaacactgatgggggattcgtgcaccaggcccaatggtgaactctagaatctctaggtctctagggttccttctaattcaagaagccaagtgagacactgtagcagacagtgtctccaggcagggtactgagcaaagaggatagtgaaaagggcagtgaaacatcggcctttttcactggcaacttcaagactcactgcctacaatgtaagtattcctcgtattccctaacaacagttcaactggaagagtggtttctgtgaatccctttgactttttatcttgccttggtcctggctccatggaggtccactgtccaagaatagaagagctggacccgccatgatacacccttcgtcatgttggccatgtctggataggtcccttgacttcagtgtctttcttaaggttcctgcctttggttctctttgcttcctctttggatttatagccggtttctgactctcttgtgcttgaatcttatttctcggttttctgtctctatcgccttctagactattacttgtgatttaaaaaactatatttgctagctatctgaaaatcaagttaacattagcaaaatgttttagcaatgctctgggtttctacatctttacttttctgcggaaggtgagagacatcttacatttggttaggatatttcttagtttcccttgtgatttttggttttaacaaatgagcaagccccagggtgattattataacaattatttttacctacgggcaagaaagggaaacatattcaaccactaacattgacttagctttatttttaagcatcccaatcattagcaccattcattcatttaacaaatattgaactctgttttacagtaatttactgtgctgaatgttatagggaatgagagtgtgcatattacatgttaatgatattgcctagcatttagtaggtgcttaattaatgttagtacatttggctgttgatgatgacaaaaatgatgaaagtggcatacatagtattaatgaagtctattttctgtattataatatttggaagttataggagattagcaaacaagctgcaaagtaccaaataagatatattaaagcaagagttcagtctcaaatgctagtgaaggaggcatttctaaatgtgactaggagtctcccaatttgaattttcacttcccttaaggtgacctgagcagaatccaaatcctttgacttgatgtgggtggacagctggtgcacagaggagctaggggcacaattgagctggaaaggctgttaactgaagtatcctaagactgcctaattaaggggaagagatctggggagctggaaggtgggaaagaattgaattcttctttatcaaagggcaaaggcaaggttatgaaagtaaatgagtattgtgttcagatagagaaatagtggtatagtgaatgcagcaaagatacttcaaatgactgagtcctgggaaaaggagcatgtgatggaacatgcctattaggcagactagtgtgttccgctagagaaaagttgcacttcgaagatgtggccactgtctggaggtacatattttaaaccactgtatccatatcagtccaaccaccatgtttaatctcaggaatctggagagatttatccatggtatcgggatcagtaagcactggaaattaagagcgtaagactgaagtaactatgaaaacttatagttgaagtggtcactccatcagcttccttatgtgttggcaagatagtgttagaaaaacatctttctttttctttctgtcttcaaaaaatgagctgacacattccatctggaatgtgtcattaaggccagtagcagattgccaagccctccaacaatgaattacagccatcaagctgtggcattggagaagtaagggttaatcattgtgtcattggtatccacagagttcataattttggactttgtgcaaatggaaaattgtaatcttcagctgccttttgccaggctacagaatggcagcagagtccaatgtgatagacatattagtggtaaaaagcctgtttacctggtgcaaacagggcttatctttcaagacactatttgaagagtacgcagaatttcttgggagaggaatattctggaggatggatatattcacttgcccctgtggcatttgttttctccttgtaatgtctgtgtgatgtgatggtaaattcagaatatctgttccaatagacacattcaatgtaacactcaacatgatccattgctatcccatgctttgctttcttcgggttcctttaaattaccaaagtctcttgtatgtgagctgctttgaccagttttcattttaggaatgagaggaaagcatctcttaccaaaaaagtaggaaaattccaccattagttacccatttaatttgtttcaaatagcatgtgaaaaacagcagtcatctaggtaaaagaatgggctgaatccactagaggtgcgtagtatgagttttttaaccaaattcctttactctaatacttttgtgagatcagatatagttaaagaatgtttgattgggtgctaggaaagtgagagaaaacagagctcattcacgacagagagaggaggccctggtgtgttgccacaaatgagtagcatcttggataaatgcaaatgtctggaagtcaggggagagtggatattagcagaaaatgaatgtgcaaaagggtttgaaatatttcaaactttataaatcagcttgaggctactctgcatgatctaacttttttgaaaacaaacatgctgatcaagggggtcaaattggtgagctcaggtttaatggactaaaactgagaaactaaaaattacagcaactgccaagaaccttgcatatccttatcagtttatgatatttactcagatatattgatttcaagacaaaaatatatctttcaaattgtgtctacataaaatatcagggttaatgtagaagaacaggacaacccatggagtagtactatttaccaggccctttatttttattttttttaaattttttgagacaagatctcgctctgtcacccaggctggagtgcagtggcctgatcacggctcactgaagctttgatctcctgggctccaaccatctgccccactcagcctcctaagtagctgggactacaggcacgcaccaccaagcccagctaattttcggtttttgattatttttgttttgtttttatggtagggacaaggctttgccattttgcccaggctggtctcaaaatcctgggctcaaatgattcacctgtcttggctcccagagtgttgggattacagatgtaaacatcgcacccagcctccctaggttccttattttgtgattgtgttgaatgtttactacaatcctctgaactaacacaaagattttatgatgtagaaaattctggtttaaagagtatcaaagaaaccgtctgaggctatgtgaatcttaagggaggaattttgcattcagaactctgtgaggactccagacccctatacttcctgtagatgatcctcccctccagtaaaggcacctgtgttgaatgagtgcagaccattcaagggattcggttgtagtatgacaggggcagtagaaaactttatctgtggatgtgagagtcggtttagaagtttattttggaaatgtgtggtcaatattcttttaaattgcctgtaaatgtttctgcgcttatttgtgtgggactctaaatgacagaatagatagggaaatctagttacccatctatctcctaataaatcattgaagacaattgcatcaacagaagtatgtgtatttcatctttgctgaagggcacatttaaaaaaatgttagttcaataatctcatttgtaaatctcagaaatcttgtgatgtataatttttcaccttaaagagtttctttttctttcattcattcatttttttgactttatgagagaatcagaatctctttgacatcatttgcagaacattgcagatgaataaaagggtggtgattgagttattccggtgttgaggaaagagtgtgggctttcaagtcagacatgcccatgatgaagcgtaaatatgtattttgagttataaaatgaagacaacaatacttctcacaggatcgtggggaaaattaaatgagataatggctacaaaaaatatttagctcaataatttgaacacacgaagtagtccctccttatccatggcttcactttacggttttagttccccaaggtcaaccatagtccaaaaatattaagtggacagttccaggcataaacaatttataagttttaaattgtgtactgttctgaatactgtgatgaaatttcacaccattatgctttgtccctttgtccagcacatccgcgccatccgtgctcccagcccaccagtcacttagtagctgtttcacttatcagatcaaccatcacagtggcactgtgctagtgtccaagtaacccttgttttacttaatggccccaaagtgcaagagtggtgatgctgtcaatttgcacccgccaaagagaaactgcaaagtgcttcctttaagtgaaaaggtgaaacttctggacttaataaggaaagaaaaaattatatgctgacattgctaagatctatggtaagaatgaatcttctaagtgaaattctgaagaaggcaaaagaaattcatgctaattttgctgtcacacatcaagctgcaaaggttttggctacaatgcatgataagggcttaattaagatggaaaaggcattgcatttgtgggtggaagacatgaacagaaatgtatttcgaacgacagcaatcaggttcagtactgttcgtggtttctggcatccacagggggtcgaggataaaagggggccactatagtaagtgctcaataaatgctagccacaaaatcattatcattcttattgctataatcacacatgagaaaatcaattatcttcttcaggccttggattccaatcttgtaaagtgaggtttaaatgagaatgcatatgtgaagcatttgccttacaacacaaagccttaataagtgccagtgactcttctccatccgttttcatccagacaccactttcttgccaactaactgccctttgctaggcttgagaatgcagacggtcaaaattgacgctattttcagagccacagaatttcaacatagcctatctgggaaggtacacattctcaaatttaccttccctgactacagaagttaccaaatgtggaaactttgatccatactttatctaattagataccaattagctttctgctataagaaatgtactactggggttagtactactgggggttagagcatcccaagtatattgaagccaatcatgtaattttcatcagcttttcttagaactcatttttagtcagtgctattcaaatgtattatgcacacaaatcccctgatgaacctgtgacaaatgaaggttttgtttcacaaggttggggaagaggctggaggttctgaatttctaaggtctcagttgatggcaatgctgcaagaccatccctttgagtggttagagtcttgggtccttgctaatattgtggtaggtaatgagccctcaccctagttagactgcagctttcaccagcagataccatcggacattcctttgatcgtatatcttccactatcagctttgtgtctcattttttcagcatactttcatttaaacgtgaatgcacttagagtaaaaccactcactgctcctcaaataattccctttaatcttgtctctgcgtcttttgtccctgtgtctttcttttatttatttatttatatttttctttttagtacccttcccctttgtcagctttgcaaaatccttccagaccctgtttaaatctttcctcctccgtttagaaactggcttgaaggggagaggtgtcattgccagatcttgaggccctgggaggaaatctgctggaaggtggggaggtgtatggaggatggaagcagacacatgagttaagaggctgatgtattagagcatgaaagaggtgacgtggtcttgaatctgggatgatctccaaggagatgttcctgatgagcttatgacttgggcaaattggctaagcaacctgagcctctgggcctttgtaaaattgcagagatggtcctatagtctctaaattatctttcagattaaatattctgaatttggtgggctgtaagcaaatgtgcacaggcctgttccaaagacttcttagtttggatcagtacattttagtatgtcacttctattgctaaaaatctttattttcaaatttttctgtcaaaggtttttctgaaacatcaactgagaatgaggggaaaatgttgctttaggagattttatctaatcttattaatagcaaattgtatagagatttcttatgaacatttaagaaatagaattcattcatcctaatctactgctagagaagcatttgtttatagagagactgggtcctttcatatcagaaagcaagtgacacctcagggaaacatcagctatggctttaagcagatgtgagtgtcaacaaggtttgagttcctcatgtgccttattgacacttcctgttataaatatgacttataggtcttttcaacaatgacaatgacaattgaggcctgaaattatgcccgattgtctgaatacttagataagacggcattattttctatatattttatttgtgatcaagttctgtgattgcctttctacttagtttttgctgtttttataaaaatatatactaaagacaaaaatcctgacctcattcacacatcacgtattagtagagcatgtatgaggtattgggtaatgagctaggcttctactcacggacctacaattaatgtgagaagtgaagctaaagacccaacctgatgattagttgagacttttcaagtatttctctctagaaaaggcattgatttgaggatgttgtttcacatttctgagatgcatctaggagttgtcatgtaccattagtatataaatccggagtggctaatcaggagggaaaaagagaataatttaggagtgacaaccagatacgtagagaagatgatgtagatgacagtctgatgggggtactggaattagtgcatagtacttaggtaagtctcatgtgttcctctgcagtttggatcataaggttgtctgatagagcctgttgtagacatcagataggcaccatctgcatgtaacccttcctatttctatttgtcctacctgcaaatcattttatttttgaagcacatctactcattgtctacatagactttaaagactcacactatattttatttcaactgtttcctgctttcatgtgatggaattacagctttccacacattgtttgctgccaagaccctaattggttattggacataaatgtcctgggagaaagtcaccatcccaacatgagttttagcctcttgcttttccaaatgtttgcaatatctttccaacaatttctttccctctaatcatgttctgcttctaaatgagacatctgtcaaagtacataaaaagacaaatgttataaaagtgaaatgatatctaatttttgacttatttagggggcatcttgacttacatgttttcattacacttgaaatataataattactgcatgttcaataacatcaatttgagcaagtaaacttgcaaggactcaataaggggaactgacagtcatgaatacctactttgtgtctggggatttgctaacattatttcattaccttgcaacggggtgtgtggagtgttgctactcatgtccacctatgtaaagttcagaggcctccatgagtccagaatacataattacatgaatcagagttaggatgtgaacacacatccataggactacaatgtaatttcctttcttgttggaatttaaagtgtgatccaaggccagcaacatcagcatcatctgggagcttgttagatacacagaatctcaagtgccaccccaaagcaaactgcttcagaatctttgttttattaataataagctcccttgatgaatcctatgcacattcaagagtgagaaatactgatttatacatcatgcctccaaagcaagcttctttttccctttttccctgtttcctgtcttctcttatatggctgcaaagacagtcatatggcatactttttaaataaatttatttcatttattttttcacaaaacacatctaattttctttgaaacagtccagggactcacagtactattccttgtttacaaatcctttttctttctttacctaaatagtctcctctcacagacaatttctttccttcttcatctttctcaataactgcaaaaattttctccaataaattgactcccattatcgtaagggggtagatgtatctggtgttaccctttctgtgttgtgaatgaggaacatttatggttaattcgtaggttcttcacttattttcatctcatttttcatgtatcttgaataattgctctcataaatgcccctcaaacataatttctacacacgtagtaaaaaaaaaaaagcacagtagtcaagtcgctattttgaataagcaccttagagtttctcctttcattttgtttatagcttataaatacagtttctacttacactgtgtatcacacagttaaatctgaatgatacattgagatcattttactaaatgttccagaaaataaatattcaaattcatttaaattcaataaaggagtcgactcatttcattttactattacaaattacttataatttttggtgatcagtgacattatgtaattaaacacacacatttttcttttaattttgagatatttttatgataatataaatgtgtgagatctttcatagatgattatatatgtgattaacttttttagatagccttagaatgaaaaaaatctctccaattaaactgttattttttagaaatacttcattagctttttctgcaatgacaaaacttttacctatttatgattaatagaattacccatgcttcatgttttaaatcaaacccggaatttagacaactaaagtaatctcaaaattatgaatttattccttatacagctacttatttattgttttttcacctgtcctgggataagatgataaaacaatatatggctcctgccataatattatgattaaacccacatataaacactaaaattacgtgaatttttactaaaattgcatgaattacatgtattggggtcagtgctacagtgttgtctgttcacagtagaggtgctatttggcttgagccttgaggaataatggcagatcaatgggtttagtactgaaggcaaagaaatgaggaatgctggcatatgctgtagcagtgactgagaggaggcgatggtgggatatgaagttggacaagagggtcaaggccagttcaagacaacacatgcaccatgcaaagaagggaacagccatgagaagccattaaagagccccatcccatattatccaatatatatttagtactcgccatttgccaatgattgtgctagtgactgtgtatgcaattcagttgtgtatgtaaaggagaaaaaaaatgatgagtctcagggcatattaaacaaagtagaagatatgggatttgaaccaaagatccactgttttcaacactcattcttcttctttataatcataaaatatatcatttatacaaaaaatatatattatatttataaaatgtgaaaaaaacaacattagtattcccatgtaccccatttaaaaaatgtgaacataataacaccattgagacaagtcctgtgctcctctgagatgtaaattatcttccttagcattcctaagtttgtaactatgtccccataatatattatatcttatcatacagaaacgtatttaaatagttttaacacataatgtatattttggtgatttttaagaaattcaaccttatgtttgtgagatttgtccctgttaacgtggctgtagagaatttactttcagggttcatttgtgtttcaacctcatttcttgtttctagatttttgctttactatcaatgacactagagaatttttatgtaagaaatattcatctttaattctgcaagagataatcctaagtagttttccaggtttttttcagtgatttacacccccattctcacaatctgctttccatgaccttgtcaataaaacttcattattttttttaaatttaagataatctactgggttgtaaaggcatttcaataatccaatttctacacaggtttttttttttcttataacttgttgatttttatatttctgctcttgtgaaagccaactcctgatttgaaagttgctttttcttattgatatatataggataggtattttttacatattctggatactaattcctttggcaattatgtgtcttgtaaattacctcccagtttatggcttgccctatgattttgacaggcagaggttcttaattgtagtacagttaaagatatcagcccatcctaattctttgtgtgcttcatgtcttgtttaaaagtagccctaccctaaggttatggatatgtattggtctatttcctttgaaaagttttaaagatctggtttttatacttaagtataaaatccatttgggattgacagttgtgaatgatttagcagtggatctccaatgctgtttttttctatgtgaatgtttttgaagagttttaggctgagatgttgcactaggttcatttttgcttaaaatggactggattagtatgtgactaaagacaaacagatcagtaaagaagtgactgaaggccaggcactgtggctcacgcctgtaatcccagcactttgggaggccgaggcaggtggatcacctgatgtcaggagtttgagaccagcctggccaacgtggtgaaaccccgtctctactaaaaatacaaaaattagccaggcgtgctggtgggtgcctgtaatcccagcaactcgggaggcggaggcaggagaatcacttgaacccgggagacggaagttgtggtgagccaagatcgcaccactgcactccagcctaaaaaaaaaaaaaaaaaaaagaagaagcgactgcaatagtccaagccagtgatgctgagggtgtgaactaggtcgctggtaataggaagaatagggagacatacaagatattaatacttaaaagccactaaaaacaggatttgttatctaattttaatgggtatgtcatacatttttctctttaaattcttatgaattttcagaataaaatatactactgccctactatggagaggtgtccttgtgtgtcctttacttgcagtgttcttcctttagtcatttgcagggccccttccttcacttccttcaaatctccactgaaattcactttttcactgggggctcctttgagcctcctttgcaaaatagccatatctgtctcccaagcatatatacatacaaacgcctggcaatgaatgcctgcctagctctttaccatgatatgtattgcttcatatgacttataaccatcttcacatgatttgttttgtaatgtttatattttcactagataacaaactctatgaaggaagaagcttcacctgtttgttcactgccatatcaccagagcctacttctgtatccattaaatattcgttgaataaacaaaagggcagaaagaacttgtatgtcaatgatgtgcgttccctttttagaaagggaggcttgtggcgaccttctaaagtttttggaattttaaccagcttttgtttctcctgcaatggtgaaattctggggagatatcagtgacccatttggcttagagctaccttcctattagattctattgtaacacttgtggaacaggtgaaaagtaaaggtgacaggcagtaggaaccattgggaatacaccaatttgggctgcacatgccgaggttagtccattcatcatctttattccacattgacagtaaaagcaatgatctctaaattaattagatccttagagataaagcaaaataaaactgtgaacattaataggcccgtatttcaacacctgcctggactgaggcaagctcttcctgttcaattgctttccttccctgccatggagctgcattcaccagcagtcctccagggggcaggctttgaaattttcagagttggattgcccagtctgtcttaatccatacttcagggaagaaaccatgatagttgactgaataaacatgtaaaacaccttgtagactggatcctacaatctttggtcacaccagagcttggcaagcatgttgtcttcaagccacactttagagacagaaacttaaagagatgtcagctggcttcagtgttggtatgaagcctgatagctcagctgagttaaatgactcccaacaaccaaatacatggctcttctagaccagggtttctcaaatgttaatatgtatataattatgtggagatcttgttgaaatgtaggttccagttcgctatgtctgtgtgggaatctaagatcctctatttctcccagtctcctctcagttgatgctgatattcctagtccctgaatcatcctttgagaagcaaggcacctagatttctggtcaaaatgctgaaaattaacaacccaaatttaaagatatgtggtttgttttgcttttttgttttgtttttctttgaggcaaattactagaaccaaccaaccaatgaaggttcttcggctcaagaacaaaaagtctactttgaaatttacattttgacatgaagcaaaataaaatgttaagcctagttatttttcatttaatcctaggtgagataaaaaataatactgcttctattaaactgacataattatagtaaaatgtgggtgaaataaaaataagatctttattgtatatggaaaatgtagaatcaacactgctaaaaaccacatcaataaaacaaaaaatgaatttaaaaagcacactcaggatgcaaaagcaacctctcaggagataaaaattagcataagagttatgaatgaaacaaaactcaggaccatagaaatattgagaaacctggcttatcacactcaaataaaattactcagtagaaactaacatgtagacattttctgataagttttgaaactgcaaagcaaaagttagatgttttattctacatagtacaaaaaatatgtttatttcaaagaagataaccagacaaaatttgaatttctcctctgcaatagtcaaaaccagaaagcaaaaagaaacatctataaaagtgttagaaaaatcaaatgtgaaccaagattttacatcttgacatgttgtccttaaatgtaatagcaacagaaagacattttcagtcatgcaataactcaagaaatttatcagcaggtatcaatctttgaaacctgtgctcatatcactcatggcagaccacagcatgtcctagatctgaaatgtatgagtgttttgatgagttaatcaagttaaagtaaaaaaaacacaaagtacattattcatcattattcataccctctgtttctcttttttttttttttttttttgagacagggtcttgctctgttgcccaggctggagtatagtggcaaaatcttagctcactgcaacctcttcctcccaggctcaagtgattctcctgcctcagcctcctgagtagctgggattacaggcatccaccaccacacctggctaatttttgtatttttaatagaaatgaggtttcaccatgttggccaagctggtctcaaactcctgacctcaagtgatccacccgcctcagcctcccaaagtggtgggattacagatgtgagccaccgtgcccagcctgtacctttttaaataagtcttagtatattgcattataacattgtagttgcttccatatgagacttcctcgagagcatggtaatcttgagaacaaagatctttatttacacttttacacctttatttgtattatcaacaatatgctcagaaaatgcttattaattaaacgggctgtcttttgtaacacagtctcatttatattcattctcttaactcctagatctgatcacgtttcagaattttgtggtggagaccataaaaatcattgacaaatcaaatttagagattgtatattgaagcgatctttccaaacccaattttaatttttaaagtaactgagggcccaaagctgtgtctgaagcatgacttggaacgtgtgtacacacaggtcttgagaggactatgggaaacagcagctggcctggcgcgtgactcctcagtcccagattcatagagcatcagggctgctacttagaagttactcgtactctgtgcaggtggcacggttcactcccaggaatgctcttcttttcattgctaatcattgttcaccattatctttgcaggctttatcaggatctcctttgatgtaatttgtagtataattgaattgcagcagatgaaagcatttcctcccaagctctatgactcataaccaagtggttttcaattatgtcagcatgtagctttccaaacaggtcttttcattgaccactatttgtatacactattgagttaactttggcaaacataccaattcatagactactgtggattctaattaaactgagatggagaaagataaaatgatcattaatttacattaaagagtagaacagggtgtttagagatttgcctaggattaattttataaataatattaatcactatcattactagtaaatgctaatgcacattctaaaacccagaggccgcatggggcttctccccgaagactaccactgatgaggaagcctgtggagccaggtttatgatatgggaaatttcttgatcctagtgttaaataatttagtattctctcatcctcccatgatgcctctatagtagaaaggccgacagctacttctgacccatgagaaaacatttcatcctgtaaagcctaagagagaattattttttgagttttaggaccaagaagtcagaattttactcttttattttcattttataataaccaacaatttcacatgtattttctgtataatttaaaaagcacttttataaatatcatcttacttcattctcagcactaagcctgtatgagtcatagtgaacacttgcacactatcatgtttggtagtctgctaagcactttatgtgagaggcctcctttaatcctcacaactctgtgttgtgccacctgagactgtatccattttacagagaaggaaagtgcagtacagaaagtttgcatagacttctagagatcacagagctactcagtactggagcaaaagtccaaacccaccatgctgatctgcttctagaaaaatgttctcatgattgttgctctgagagtgtgcattgcggtcatcgccgtcctcctggtttaaagaagtatcttccaaaacccatgttagtaagaggttggctttggtcataccatcctaggaaataattttttaaaatttgctatggcatcctgatgaaagtttgttgtgccttctccagagtttccataaaatgtccaggtactttttgctttcattttctgttccagttaaactcaggacctcccttgcatctcacctggaacaactgctctttactctttggcccaaatgtgagacctggccccatttcattgatttccccaccatttgtcaaagaaatagcaaagctttggggaaatgtatgaggtgttcacttaaaagcttacaacaaacatcatgagaggtttgacacttttgtttctttaaattttttgtgtctactacctaaatttcctcaaaaattttctcttcctgatctttctcttgagctctctgctttcccccatgtggctagaacccttctttttcctctcctgatgtcatgaacttataaattccctttggtctggaaatctcaatattctcattgtaacatgtgtatatgtcatgggatcctccaggtgtcacttcacctggaggttcacagaggtttcagctggaaacctctgtgtccggttgtgccttctgcctaagtattgctcacacctgctgggcttattccgcccacttcacctggcaggctgcactcggctcatgctactggcctggatcccacacctgctaagggtgagccaggggtgcagcagtgaggggtgtgtgggcaagcaagcacggagaccagccactgtgcactggctaggcatgctggctgctatggcagggcaggcagctccaggcgctagcacacgttttggctctgtgtgaagctgtggctggaccacatgtggtacatgtggcatggctgaatggtataattgggcatctgcatctggacgagaggaacatggtgttgcccagaagcttggagacaccaggaaccacagagccccaaaaagggtgtcacagccctggcttagggatcccctatgtctgggctccctgaacggccacagctcttctctccttcttgtcacccacaatgtggcaagtgggaggtgaggtgtttcagccatgttttttgttacagctcttctagtcctgccatttggcgtatcccgagttcttgtcccacatccaggacgaatgaggtatgcagacaactggagggtgatcaaggcaaagaggagcttcattgagcaacagaacagctctcaggagacccgaagtgggtagctcctttccgcaggcaggtcatcccgatgagtgtccagctctcagcagagaggagacccaaagtgggtagctacttttcacagacaggttgtcctgatgtctttctgtgagtccagctgagtccagggttttcctgggcttcagaagggaggaaatgcatgctgattggtccatgggcagccatgggtgggcccagaaaaagcaccataagttctcactcctggccgtggactccacctggaattccacctgaaggtgggtctttaccccttcccacagaggagcctgtctgcctcctacttccttaatcatgttgtccatagtgcccagtctgttcaagtggagggggcctgcaggcccacactgagccaccctcagcagccccaactcagaaggaggtggggctcccagctgttccaggctcccacaggctcagcagagcacgcagccccagccatgcttctcctgctgcaactggcatccccgcacccagctctggacattagatacacgtaatatctttgttgcagtcctcattttcccagaccatgcctgagagtgttccactttgtatggaggaatatgtgggtattttcataaatgaggacccctctactagaaagtaacaaagtattttcctgaacaaaattgtacttatctatgaagtagaagaaattgtatcagttttggttttaaattctaaatgatcttgccttttccacgctgctgaaaagatttccccagtttccagtcttgcattgtgcatttgtctcttcccctttaattcagcaattctactgatggctttccaagtaacagccccttctgtatcattgtggcctttggaacattttggttcctggactgcctttcttccaggacctcaatgaatctctcaagctacagatttcaatagcaaaattaccatttaatagctgagaaaactgaagcccaccaatattaaataagttaccgaaagccaaatggtgcctgagctaggactacaaacctgatatggtagattttttctatattttaagcctgaacaatgcaaattgcgatttcatataaatctcacagttctcagagttctgtggcctgtttccaggcacttgtgcttgttggttctttttctttttttgcataaacttgctttgtttgcttctcttacctctactcctggttattttgtccaaattggtccaagtttgattcaggtaagcctggactcttatctccatgaagaatgaaggtgtatgccccaaaacaccgaataaagatggactaaatggatgaaaagagctactcttggtaaggaagtttgccaggatattacactagaagttcaattcagcagccattaaaaggtctgtttccctggggagttctctactgaaaagacattagagcctttctcccttgcttctttttgtatagcagcttttacatggtagctgctgaatgcacagaataatgtggctgatccattgaagacccagcttgctcaggttagaaagacagagctgtgttactaggcaaagtgtaagaacaatttatgataaataagtgtgatgaagggaaggttcttggcttcactcaagcctgcggtggaagaaagcagctttacttaagcagcagtgtttatgcttggtgattgccccttgcagagcagggctagcccataggcagtgcgtggagagtagccacgcatgggctgttggctagctgcatttatacccactattaattgtatgcagattaggtggtgggttatttagaaatcaatagaaaatggggtggtaacttctgggtgttgccatgtgaaggggtggtaacgcagcgttgccatggcatttgtaaccgtcatggcactggtgggagtgtcttatgctgatgggcagtgaggacaactagaggttgttttctgtgccacttgctggttctggccagtgtcctctttggtttgggaaacaagccctgcaagtctcctacttcaggaggctgtggaagagggcaactaacttctcaggagggatcagaccattgcaggacaggaggcctgtggaaggaaaagaagacaggaggagatggttttcttattttagaaaaaagaaaggttttcttcttttagacacctgggccatgactcttcacttgttctttctcaagaacagtctggacactgagaccagaacctgggacttttaaattttaagcatatttttatgtatatgttgtcctgtctagcggagggtgggggagtctttcttttttttctttgcataaatctctaaattaaaattctccagctattgttacacataaattccagggctgcacagatcgatctgagtgttcccattaagtttctgattctaatgaagggaggactttacagcatcttccactgtctcccaacgcatcacacctcttcctgcttttccctgacccacctgccatttagaaaaacatattctctcagccctgctttgtgctctaaatgttaaatacatttgattgtccatacaattttatttgaaattcaatatctgctttggacagaaagtgttattgacctgctgtatccatacactatttactttgaaaataaaaaagtggatttactttgaaaagaaaaaaattttaatgatttttttaaaatcctaagtaatcatgatgatgcccttaagaaagtttttaaaaacataattagacgtattttgtaattgggatcattcagactgccaagtgttcaagcttttccttatttgaaggcacattaattttttaaaataatcattaacgaagaatttacttctcttaaaactaggttagctattgttctctctctgtctcaactaatgagtttgatattcacaagaactaattgtgagattttgtaaagccaatgctatgtcaactatgctggaataagactttatgagaaaaacataaacatacataagctgtcaaataaatcattctgaatgatgtggtagaaagcttggtgctaggagacctgataggaattttaatttacccatttacttattcatcaaaagtatataaagcactgatcctaagagaagcagcaaagccagctgcaatttcccagcagtgtaaccttgcgccaatgactatatcctctctgatcctttgtcaccctaaatgtaacatgaaggaaaaaatatccattacagcataatataataattactataaaatataatatttacccaagattcttatgagtatctgatgaggtgacatactaaaatagatgagacaacagagttggaagcattttagaagacctaaagtcattagtggtgtttgtgctaataatgaaacatctattactctgggtcctttgctgagttccataagaaggagaaggttatgtaagaccttattgtgggctttacatgctttggcatccagtacaatggaaagagttagaaaatagaggagcattgaaagagaatccccaaggctgggtttagtactgcaatttgcaaatgagggcattagtgaaaagcatcctccatggatgtgaagcagaacttgcagtaggcagcagtgctctgggagggcattttagagggggatacacagcactgaaccttgaaagatggagaaactcagtgaacacagatgggtccggaaatgcacacaggacatcagtctacttacaggatggtttccgagagcaacaaagtgagtgaaaagactaacaactaaaaatgaggagaggtttggatagcagagaagagtggagtgattcttccttaaaggggaattgacacttaacatcagatgaatgacttagaacctagatctatcagttatactttgcactgaaaagctacaaacttttaacacttagctgtcccatctgtgaatctctgtggctcattattgctgtgaggattaggtgaaataaatacatcacagtgtctggcatatattaaattcctaataaactttcagttttatttttctactttccttttccttctctttatattggcagtggggtttctggcccttaatttagagtggaaacaccttatggttttctcttatcacattttatgacttagatatctcttatgtttatatcatctgctccctacatagtctgggcccggaaatgattatactcagagcatctctagcaagacagctagataagcagataaatgcagccctcaactttttattaatcaattgaaactacttttccatttaaatcaaagccctttaaaacttccgaattatattattaatgtccaggagaagatatgccatcagttaagtatcctctgctgcctattggctgctgtctacttattgtaaaaaaactagctatttctaagtgttgatgatttcagatttgagttcatcttgttaagtggttcagaacatcaactcttagcatacattccctactgctaaataaaaggtgacccttcttttaatcgtttttgtggtttctcattagagaataggtaaataatgaaataactagagtcttcccttgctttcattcagttttgtgttgttctttccttccagttctttgcaactacacgatcaaaaacattttttttggtgcacattaaaaagactagagaaatgctttaatactttcgaagactgaatatcttaaaaatggctccaattctactgtcttattcaagcaaggtatttacttcttatttcttttctatccatttcatgaccttgttttatttcaagcactatcacagagtcagatggaccttaactcacctgagcaaaggcaacctagagccacacagctgagctgccctctttgtggcatcacgttgtccctctgccccacagagtcacctccccacttcccttttccagccctactgcccttttgtaagtgtaagacatcatttcctctcaactgcataacagaaatagcctctgaaagggcctttttacagctgatttcttctgtctccaattcatcgtccatactgcatccaaagtcttcttgccactgccttcaaaatttaaagctgattcctaaattatgaatctttgtcactgggaaggcaaaggacagttgcatagtctggttgagtgaagttttgcccacacttaactgaaaaaaaaaaaaaaaagattcctgtgccccttctgagacttgctgaatcagatttgaggaaaaatcctggaaatctataaacttagtaagcataataagtgacatttataagtggcctctttagaaagccagccctgcagagtacacagaatgaaaatctaaaagtctgagaatcccaggttagaattgcaatactgcatttaacatctgcagagagcttccaggtaagtcacttaacttccctgactacattttcccattgaaaaacagaggtattaccaacttacactcatcactactctgaggctcaaatatgacaaaatacataaaaaggctgacactcaatgtataattgaaccttccacttccctttttgatctaaacaattactcttctgaatatggtggaaaggttgaatggtacatttctccctccttccctgctaccctgccccccacatgccagctgggcttgcaaaaggcagaactggattccaaaattatagcagcagccagtatggtcttcggtttccctgcagacacatgagtcaatggagacccacaggactgaaacatagagggtttatgtttccctgaaaagcaacagaactggcgaaaacagctctgtttctcagagatgagtgcaaactggacttataatgaaaagtcaccaggatgtgcccagagaagtttccagcaggaacacctgcccaaagaataatgtgggaccgtgcttcagcaccacattccagaactctgagtccaaacagacccagactaccgggaagctcctgcaagcagagcaggacaggtgttgatgcacatctgagacggggagttcctgggctcaggagaagggaaagcctcctgagcagcagcccagcagggagagaggcactagccagtgggtctacgtccaagaactgccacaaaggtcttaatgcatggtgccaacactatactctggctattgccaagcttgactcctcagaggatctctggggtcataacttgctctacacaattgttctgaaggtgattgcaggtgtgatttctagaggtggcctgaggcaggctcaagtggaccccagattattgagacctagaaatgggaggcacacactctggttaggtgggcagatgtttaatgtggaatccagtatggggcatggtttgtaggcagcattttgcagaaaatatgtccaatatgccctgcctggttttgtgaggccagttccagtcccctcactaacctgtcctggagtctggatggcttgattaagattctggaccacagagaacccagacaactgaagctatctttccctgcaagtggccactaaggggtctttcctttcttctaaagctcaaagcttcaaaatagtggtgtgaggttgaataagccatttaatctcctcagtactctcaagtatatagcggggctaacaggctgactgcggctaactaggataacaattcgaatgcctagtatacctgttgtagagtgctagcctcattgttattccccttttacttttccttcttctgccagagagatcatctgggtattcatttgtgtgcttaccgtctgacacttgcatttacatcattatctgccactccaggttatttttctcctctgagagccaaggatgacaaaatcttccttagggtaatcctacctgtggagagagggcaagtacgaatggtgtttctctagtacctgcaggactagtaggtgtggggatgtaagagcactgaaatgaaaaagtgaacatccttagagactggctgctttgggagtaaggcagatgttctaacgatttagagaaactctcagaacaaagcagggataggctttgggaaccaggatatgggattctgaagtgggaacaaatccaaagaagcatcattcactcatttcacacatttatcaagacactagaatgtgacagtgaacctatcagacttgcttctaggcttatagagctgagagagtggtgagggagactgttatgtggtcagaatggtgcaccatcaacgttcccccactcccagttaggactaaggcactgattctcccagctactgggaggcttggctgctgacaggtgagagctcacagctgtatatctcttccagaattgcctttgcggaggagagctgacacaggtgtcagctagcatcttgcagctggtagacacagggacccagccctcttccctcatctcagacaaattttatcttcagagtaaccccagggcttgactgaggtctccgttgcagctgcattacagttcacttgttccctagacccagttcttttttttaattgacgtataattcacgcattataaaatacatccatttaaagtataaaatttggtagttttttagcatatacataaaaagttcttcaaacatcacccctatctaattccagagttctcatcacctgcctgccaataaaaccaaaaacaacaacaaaacaacagcaacaaaaatccatactcattagtagttgcccctcattcatacctacccccattccctggaaaccactaatctactttctgtctctatggctttgcctgtttcagacattttattttacatcttattatacttacgtagccttttgtatctggcttctttcattcagcataaacttttcaaggttcttttacattgtagcttgcaacaccatttcattatttttattgtcaaataatactgaattgcatggatataccacagtttatctttttatcaactgatgggcatctttcctctttttgattattataaacaatgcttctttgaatattcatgtgcaagtttttgagtagacatgtgtttttaattctcttctctatatacccagaggtgaaattgctgagttatatggtagctttatgttaaacatattgaagaacagtcaaattgttttctgaaggggttaccccatttttcattctcaccagcaatgtatgcggggcttcgacttttctgtgtccttcccattacttgctattacctgtctttttgattctagttatagtagtgtgtgtgccgtggtattccattgtgatttttattttcctctacctaacagctagtaatattgagcatcttcttatgtgcttacaggctgtttgtatattttttttgagaactgtatatacaaatattttgcccattttttaattatagacactttttttttttttttgaggcagggtctcactctgtcacccaggctttagtgtagtggcatgataatggttcacttcagccttgacctcctgggctcaagtcatccccccatttcagcctcccaagtagttgggaatacaggtgtgcacgaccatgcccagctaacttatttgcttagagacagggtctcactgtgttgcccaggctggccttgagctcctggactcaagacatcctccttcctcagcctcccaaagtgttgagattacagaggtgagccaccacacccagtcagttggtcattttttattattgagttgtcagagttctttatgtattatgcatccaagtcctttatcagttacatgatttacaaatattttctcccattctctatgctgtcttcactttcttcatggtgttctttaaagtacaaacatttgtcattttgatgaagtcaggtctatcttttttattgttttgttgcttgtgcttttggtgttatatctaaaaaatcattgcctaacccaaggtcatgaagatttgcacctatggatttatttctaagagttttataatttcagctcttatatttatatctttgatacatcttgagttaattttttcctttgtgcagttctgatcatcccaatactttacaggtattgctcccaagtacactacccaataaatctcttacactaaaatatttatctaaagtttatttttctagaatcagacagattattcatagaagtacaggtacaatatggtaattgaggaagtggtggaaactctaagcacagctgtccaggcagggttctgacggctggcatccttccaaagggcaggcagtcctgtagaacatccttactggtttggacttcttttttcccagctttgctctaaaatctatactattttatgacagtgtttcagtcgtagagttcaaagcacaggcaaattgacattcaaaacttattatcggatgaagttacatatctgtttatatatttcaacaagggaaagctaatcaatattctgtagcaattgttaccatgtaacatacgattaaatattataaaagtgagcctattacatgagaaataaatataattatgtttggtccaggctgttaaaaatgcatactttctatatattatatgttaatgtgcaagatggagtggatttctgcttatttatttaaaaagaaattaaagtagtacatttagcgtacattgtgtgtctagatgtttacagattgattgtctttttggagatattttagcttattgtattgtaccatggagtaaactttatgctcagaagttctaaaggaaaaagtgtaagagattactggaattgaagatttttgcatttatatgtttaaattaaattttgattagctgttttaagctttgtcaagcattaggagctcataatcatagagagtttgatatgaaggataccataatcagctactctgtgctttcattttacataaaaagaatcttcaactcaaagaagaagactggggtaattggccccaggttgtggatgaatcagctatgactccatttggtatccatatctgaccattcctagccccagggctcagttcttgcaacaagctgcctggatgttttccaatgtggctcaatgctgttaatttaaaagatgcgtaagtttctgttaagacatttgtgagttggggcagaggaataaaaggcatgtagcttttttcatcaagtgtgacaacacctgggtgttaggaaacacacataatcaacttagatgctcatcagtggtgggctggatgaagaaaatgtggtacatatataccagggaatactacacagccattagaaagtgaaatcatatccttttcagcaacatggatgcagctggtggcccttatcttaagcaaaataatgcaggaagagaaagacaaatactgcatgttctcacttacaagtgggagctaagtactgagtgcacatggacgcaaagatgggaacaacagacactgggcctacttgaggtgggagggtaggaggagggtgaaaatcaaaaactacctatcgggtattatgcttaccacctgggagaggacataccttgtacaccaaatcccagagacatgcaatttacccatgttacaaacctgcacatgtaccccctgcacctaaaataaatgttgaaaaaaaaagccactaaaatagtatttcacatcacttttcattgctaacagtttgttccgtcaaaatactttctaaatggatccattattgtttgtcagtatataataacgtgtgtaaattcccatagatatgcctgagttttacacttttcatttcatatcagagaaaaaagcttgaaaaataactcttgatattgagaattttaacagtgagattttattatactcaaatgaacaagttctcatcttcatagcccatatgtgagactttttgttaccaaattgtaaaaaaaaaaaaaaaaaaaaaaaaaaaatcatgtaacgtagattaaaaatctaatttcaaagactggaacaacaacaaaaagaaaacaaaggcaacagcacacagatgactgtgacttgcctttggcccatctgcagatattaaagccctggggccagaagcaagtctttctcttgctgagagaggacctgcctgcagcaactcctaggaaggctgatgagcaggtagtacttcctggagcagaatgggccacccttctcctttggctccattcagaggaatagccccagggagaggtcctggaaagtattataataattgcagaaatgaaagaaaaaacccttgttctgaagcaaagggtggacttttaattttaatagtagctaattatccgtgtctgtaataattctgctgtttttgatgtttttaaagattaaaaacaaaatctcagaatagctttcataaatcaatttgaccttgccgtgaaaccaaaacaacggttaattcactcgaagcagagatataataggttcaaatagcaacatatctcccagagtcaatttcaacaagacaaaaacagaataaagtggttcatatttttatgttaaaagtaattttataggattccttttgttgcgctgaatttaaataaatcattataaacctaatatatgcctaatactgtcaccatgctgtggcaaccactgttaatatttccatgtgttttctttgaactttttttaattctttgcatgggtttttaaaagagtgttttagattctgtcataccagatggagaaacctctgcccctactctgaagggatatccccaaatgacattccttggaattctgcatcccttgaaaaaggacgactggctgtcttctgcatgagctgttccgagacccactaaaattggccagggtgactggtacagtcataggagggttcagccaagccatagcattgtccagagcaaggatggcgtaaagaaggctttaacaaaatatatttgattataaaaaaaacttctgctaggaatgtacaaagttcattgtccatccggacacccaggaataagtgagaggtacatactaattagtattttctaacattgcttacttctgccccctgcctagtcacaggctgagagaagaatgcagcaagaagcatcttaactggaggcccattctaagtccattttgaggatgaggaaacaggccagggaggttaaacgacttgtcccaggtactgtggctggaagagaggctataccttacctactctcctgggtgcccttttacctctgtctttagaggaagtgcatagatttttctcatttggctcttgagacctgggataaacatagtgctaccctaagtcttgcagttacaagaatggaaatattctgatttaagttatagacatttgtttgaattttaccattacacattttttaaatcacagataagatttttcacttgaatgaaaagtgaatattataaaccatgaaagcttatatgaggctacaaaataagttgggagtggctatctgagaagaaaagaaagatgcaaaatctaactggcaaaggaataaaatcaaatcagacaccaacataaccagcttcttccgccttcccttagatgatagtcctgaagctgctatgctgaacatctgatgggaagtaaaaggcattaacactctgtaaaacatggcaaggaatatattctataacagttcccctgcagatgaaaatttgccctgaggtatagttcctcagagaaaatgagtttttttctctttagtaaattttttaaagcctttttgtttgtttgtttgacagcctgtgctgcagttctaggttctaagcatatacaccttatattcctgttaatggaatttcagactcaatgtttgcctcaccttttgtgtatagttcctcaatggcctatattggatacaaagtcttacacagttttcacccaactctagtgattaaaaaaaagaaagatctgattggagcacagtgcagaaggagagagtggcatcattttggagctctgcatttctggatacctaccttgcctttgtcacttgtcaggtctatgattttaaagaataattgaactcctttgaatcaccactttatctgcagatgaggtctggaatagtcagagatggttttctgtaacaagtgagtttcatttgggatttgtataatcagaaagatgataaggggcaaaccataatcaaagccccagagatgcttagcaatgagagcaaccatgctgaggcatagtaaactatgacactgatcagataatcaaggtgaggtgcaaagtcaggtagaagtgctcagtgctgaggtagtaagaactagggaaccaatagaggcttttgactcatggtctgagaagatgagaaacagccactggaagacagatccagtagatggacaagagggattgatttgaatattttggagcctggggagtaacctagagatgaatatcgccaggtcattcaggtttttgtttggttgtgtgattacaactaacagagactataatttaaaagcttggtggaacagattactaacaaactaataaattatcccaatctcaaggctaatcaaacctatattttggttgatttttctacaaggttgtgtcaaggttataggtaaggggtgatcactgagtccccgtcaatgagatacttgcccctgggtggacaagtgagtactagttgccataaataaaatcaagcacctctgctaccaacatttttgcatttcacatcagagagctgagttccgtatcttctcatggtgatctttgatccaagttaaaggccgacattaatgttaacagtattttctctactgtatattgtgactcatttttgagttgcagatgagactgaaactagaacttctcttctttgcagagtcataagtcatgttaaaatattaaaagctcagaatagtcctaatcggtttaactttgtataaacactcagatatcttgcatttctttgtttacaagtccatttctcttgtaatttccctgaatatccaatggacctagaactgtccaaaacaatgtagacaatcgctaggtctaagatatttgactttaaccaaaattgttaacaaaatatcttttccttctaggacagtggctcaatatttaatttcattggaaaccacaggctaagtctgagtatatttatgagttatattttcagctacctagatgatttacaacatgataatttagaaggagtagaaaacttggagttaaaaattctgagttaaaacctatcttgatcacaacctaagactatacatgttcaatggatagtctttttatttattcagtgtagtttcctcatttataaatataataaaacccacctgtaggtaatcatgaggctcaaaaacgactgcacatgagaatcttttgtaatagctaagcctcattagaagctgtattctggtttgaatgtgcttgtagcctatatgtttgtgttgctgcaactcctaccttgctaaaaagagataaaggaacccatctagggaaactgttatgctaaggttgagttcctaaagccatggtgtacttcaaattagggaacaggaggagttgaacaagaccatcaaggaaaaaatttattatatacagatttctggcacgatttacaaataggcaggtccctgggctgatacagaacatgcaatgctgatatgttctggatatctgggacagtgtttgcaaaacaaatagaaattgaatgcctttatgttagtcataggactcactgctaatttattaatttacgtcttgctcaagacctatttatgtccctcctttgttcccaggaacattagaggttgctaacgttgctctaagacttgagcttaattaaggtgacctttgagatgaactggtccttatcagggccagtgaggccatgaagagactagatccaagcagtatgttttaactggcctacacaggtctccctcagcagccctgagccagggaactcaacaatattttagggaaacaagaagtctacttaactgataggagtcagatttgtacctgggactgctgatccaaagcctataaggaaaaacatagccaaaaagaatctgccttaaactgatgtgaactgactatccagatccatataattagaaataatattagaagacatcttaatgtatatagtatcttatggaacacagttttttttgtgtgtgtttttaagcagactttatgtaccaaattaagaaattattattttaatgatgaagtcttggctgggcgcagtggctcacgcctgtaatcccaacagtttgggaggccgaggtaggtggatccctgaggtcaggagttcaaaaccagcctgaccaacagggtgaaacctgtctctactaaaaatacaaaaattagcttggtgtggtggcaggcacctgtaatcccagttactcgggaggctgaggcaggaggattgcttgaatctgagagacggaggttgcagtgagctgagatcgtgccattgcactccagcctgggtgacaaaaaaataaaaaataaaaaagttatttgctctagggcatgcagatggaaaggggttgcaacaggtactggagtcagcattgctgtccaaagccttatatgcacccacccccccaactacctacctccctgggataagattactaatgacattattttccttaggagcagacctctttcacacagcagtatacaagctgttttgctttctacctgatgttgagaaaggcctgactcttagatgttgcctgatagctactattttctcactttgcatcacattagtgggagccgttgctggagagtttcataaggaacattctgttaagaatgtgtaaatttagattactaccactgggaatttaaaacaatgaagagaacaaattctgctaaaatatggctctgaccatctttaagacagatgctgtgaccgtcctttagctcatggctaatctgaaggagctagtctgtggagacaggggcttccttagcaatgcctcagataaaaacttgggcccagttctcaaactcataactgaaatatttcagattaaatccctcctccttgttgctgatcagtccacgtactcttttccttaaaccccattgaaaattcactgtcctctaggtgccatcattctgtagtggtgggagtacagattggcataacctttcagaaagcagacaggcaatacaaagcaataataatatatggcaatattaagggagtctatattcatgattgagtaaccaccatgctgtgaaatgaaatgtggtcaaagatttatatgcaagagtttaataacattgcattgttatttattatagcaactctttcaaaagtgtgcgatgagagggtattatttatataaataactttgcaatcatatgatggaatattattctgccaagataaaattatgtatttgagaaatatacttactgatgtgaaaaagtgcttaagacataataggttaagaaaagacagacagaagaggtatgcatgtaattgtgtgtgtgtgtgtgtgtgtgtgtgtgtgtttctgaacatcacaggcttcattagccgatggatacaaagagatcacatcaaagtccacagtacaatggtcttacaactttacaatcttctcacaaagcgagtacaaacctgtgctcagtaccaaacccaggtagactgttttctccctttcctggccttcttatcaaagctgtttccatggaccttgctgtggacatctttcattagaacgctctggtagctgtatcacttagaactcagggatgccattctattagaaaggaggtgctcttaactctcaaatttttcttggtcttaaatattgcattgagataagggaataaggaagaaaataaaaatgcatctaatgcctaaaaatatatggactgttgctaggcatttcaccccattcatgtcatctgttaattgtcagatgttgtcactctctctgtttttaatacagaacttcaacagatcttaagagcattctactcagtcattttagatttgaggtgctattctgctctctaggaagatagggagtctcaatcctgacccagactcagttcccgagtgcggtactgtttcccactgacagatgccactgactttgcctgcctgagtctctaaatattgcagctatctagctgtattccatctgcccacctgtttggactttcatgagtccaactgctttcctggcctcccaccagttgcctaatagcattctacttgatggaatccatgttccctgcccttctgcataccagcatctgcagccgaccttccaataccgatcccagcatagtaggccaatctaggtccaagaccaaggtctcctagcctaaggatttaccactgtggttaaccctgccctgcctgggcacaacaccttcacaattcttgaagcactacgtgccatgacacacacatttgaagtttttttcagaatcttccatgtttaaacttttggctgttccagtttccccaaattaaattatctggaaagagtgagcagctgaaatttgagtgcatttttgaagtttaagaactgaaaaaagaaaggaatatggccaatttaatattcctgtctcttaatccacttcacatgggagaatggaggtgaagtgaggttgtggaaaataataaagccaattactttgcctgttcctttgtttgatatactgcactcttttttattttttcttttccaaaaagcagagatcagccagtacaaaatggtggttttcccatcctgggtatatcaggcccagatcatcaattattattgcagcattctatatttgctctcatagatagtgaaagctttgctatattaatgaggaatttttgatttcaggctgtgccttctttgctcgtctcagctcttggctcttcctaaaaactgtattagccaggaaactgagcccactgattttttaatctatccttaaccctgccctggaacacttagcaatttaggcatgtggcaggaagaactgaaatttctaagccgttcactcctgagactaataccgagtcctcttcatttatccttgacctttttagttttcagccttgctccctaggggtacttccatgaagacagttgcttcctgccccatattaacaaccctcagtgaatgtcacagtagagtaacagcgaattgcaaataaagacggccaacaatcatttggcatttgaggaaagccatagcataaaacagggtcactgaacttaataaaaaggaaaagttatgagagtaaaggaaatatcatgaatggcctaatctttctgtcctggatggtctttattccttaataccatcaaccactcaaggtgctgctgtgtccctctcagaggtccactctcactcctcctacctgaaaagaaactcactagttgctaattaccaatatccacttagggtgagttggttgggacatgctaattcctccttgctgaccctactgtgatattcctgtgattggcctggtcatttttccctgggcctcacttgcagcaagctgcttaggtaggaaacacttagagccactcctcacattatgaggtaagattctcctctggttgtctgaagctgtaatctccattttcaatctggtcctccttcatttccagatgtgttaaggaattttttaaaaaatttctatctgttatgtcattaagaaggatttgtagcaggaaaacgaggctggcaccttttctcaagaagctatcttgacctgaaacttacattctttcatcatcatgccattttcatctggtttcctgagagctgcctttggcagtcacagttggaaatgacattttatacaggctcttatatcagagcaaagtatggtcctgataaaaggttgtgtgaaaatgttcagcaaacacctctcaatcccctgtgctttgatgtcctgcatgcttttataatggccacactccagggcagctggagacaggaaatttcatataactgggttgtgtctgaacagaatcagcacactccacgatgagattcaccatattcacatttggtatattccctttccatttctttcaaacttccgtattaaaaatgcaagatttacattagtatagaatactaaccatcaactattatcaaaggaaacagaatggggagatgaacaaagagaaagagatgacccagaatcagaaaccctgggttagtcttggctctcagtgattaagcaatttgtccagcatcacagatctacaatgatcttacagtctcaatccctcattttcttcttttacaaagccaatggttggcagaggctgactagatttcatgaccctccatcttgttcctgttctgagcttttatgaagttgatcttattgtcatcagcctatcatcagctttgcaggacagccagatgaaaggagtgcaggacagacactccttagaatccctttgtaagtttttcaaagatttgctttgttcagatctctgaaccattattggggactgtagaataggtactgaagaagaaagaatgcctcgcttaagttcaattcagtcctgtacactcagagtgatctctctgatatgagaaagggagttgttgacctttggattaagtgattccaagagaaaggactgtttagagcgagggttagcaaactaccaccttcaggccaaatctggtccaccaactctgttgtatggctgacaagctaagaatggtcttcacatttttaaaaaatcagaataataatattttgtgacatgtgaaaatcatgtgaaattcaaatgtcagtgtctgtaaataaaaagttgtattagaatatggccatactcagttatttacctattgtctatggtggctttagagctacaacagagttgaacagttgcaatagcaaccttctggcccccatagcctaaaatatttactatctggccttttataaaaaaaaattgatgatcattggtttacagagatgtattgagagttaacaatctgcaggacataaggaaagaatagcaactgatagtttacagatgtcttcatgggaaaggtattctagaagttcaaggacaagatattattgagtataaacatacacagagcaagaagcagcagtggatgtatacgcttacaaatgcacaggcagatgccccccatgtataaattttcaactcggctgtcctttgtgataacacttggcagaaaaaacttcaataactgaacacaatacctttagcgttgaccattgttattttcttttttttaattatttctatagcattgacattttattaggtattgtaagtgatctagaaatgatttttaaatatatgagaggatatgtgtaggttatatgcaaatactgtgccattttctttttttattttattttatttttttatttttattttttctaattttttttattatactttaagttttagggtacatgtacacaacgtgcaggttagttacatatgtatacatgtgccacatgtgccatgttggtgtgcagcacccattaactcatcatttaacattaggtatatctcctaatgttatccctccccactccccgcaccctacaacaggtcccagtgtatgatgttccccttcctgtgtccatgtgttctcattgttcaattcccacctatgagtgagaacatgtggtgtttggttttttgtccttgcgatagtttgctgagaatgatggtttccagcttcatccatggccctatgaaggacatgaactcatcattttttatggctgcatagtattccatggtgtacatgtgccacattttcttaatccagtctatcgttgttggacatttggcttggttccaagtctttgctattgtgaatagtgcctcaataaacatacgtgtgcatgtgtctttatagcagcatgatttataatcctttgggtttatacccagtaatggtactgctgagtcaaatggtatttctagttctagatccctgaggaatcaccacactgaattccacaatggttgaactagtttacagtcccattgttattttcttagcctcttacccattggcttatttgtgctaagttttgaggattcctttttaaactgatgtttaactgtattatattcagtgagtacaaaagaagtgagagtttcaaaactactgataagaaatggcatataattattaaagaaggaaaaataaagaagacgaaaaaataaagggaagttaacgatcactacctgataaatatttggacgcgaatcatgattttgaaggacaaagaatgaaatgtgtgcaaaagcagtgtggatacaacccagactaaccagctggtgcagagggacactggtaaactagacaatctttgcagtgtgtcttgtgtttacaacaatgcaaatgcccgttagattaatgctgttgagaaaaagaacaggagttttggaatgaaaggctcatcatggttaaaatgctgctgaaaaaatgcttgtcatgaggtgcaggagctttcaaaggaaaagggtcactattgtgtcaaagaaaacacagctcctagggagtcataggataaggcacttataggatcatcaacaaacagtagtacctgcatgtacgcattctcagagtatgtggaaattggcttatttcaaaaaacaaaaccactgataggctcaatagaatgttatcatccaggaggagcaggagtgatgcttaatttgaaagagttggagtgtctgcacacaccatcatttgctgccaatttatttagcactaagcttaaaatcctctttggaggagtaactttggtcttttaaagaaaagaaattaaagcaagtttttagaaacagacattagtaaatgcacgtgttcttgctgatacatacagagggaagcagtcagagagaaggatgaacagattataagtcaactctgaagggtgtcagtagaggttcagtaatgggcagagtctagaaaatattatcaatatatacagaaatgtctgtgtatgttaaattaagggaacctctgcagagacgaaaagaagagattttgtaccattcatgatgacatttgaaaataacatttttaaacctctcattttatggtgacaatagatgcccatctctttcacatagagaagtttaatttgaaataaaagtaaggaatattctttttattttatgatgacagtctcatgctcaacaaagatttagagaagttagtgcaacatggaaaattgagttgtggtgtaaaatgtataacttcttgctacatagctgattgtgaatttgttctttatatgaatttttttaaagaaataattgaagtttataaataaaatatttatgaatatgacttcattaagaccaggtgtcaggtgtatcttagttctgttttaattatatacatatacacacacacatatatatttcttttatgttctacatactctgctttatagctgaactcatctgtatttgtccattttcatgctgctgataaagacatacccgagactgggtaatttattaagaagaaggtttaatggactcacagttccacatggctggggaggcctcacaatcatggcggaaggcttgtcttacatggtggcagatgagaggatgaaaaccaagcgaaaagggtttcctcttataaaaccatcagatcagatcttgtgagacttattcactaccacgagaacagtatggggaaaaccgctcccattatatcccactggatctctcccacaacacgtgagatttatgcgagctacaattcaagatgagatttgggtggggacacagccaaactatataatcatcatccaaactgaaagttgtagtaggatttgtattaacaaatatttgaaatctgagttataatttgtcaaatctatgatatgcatctaaaaaattaccattttcttaaaatggttataggatactctaatattcagctagtaacaagtgctttttgggtcaggaaaacattttttaacaaactgatacttatcaaatcttagaagtttgatgtcattatgttgaacttctactacaattaagtgagaagataaatgcagagtaaaggtttctaatagcattttttatttataatctcaatatatgttcatttcataaaattttaaaaattaagagaagtgtgaaaagactctacaataccatcaccaagggataagtaataagtatttattttcttttatattttttaatctactatgtatatgtataaaaatatagatattattgagtaatattattgctttcattttccaaaactctcttctaaatagtatttctatttttagttataattttaaaatttaagtggcttcattgtttttataaaatatgtgattattttaaaatgtaacgatgtatgtacacaaaataaaaatacatgaatatatatttatatggaaacgtatacttataaatgataaaagaccaaaataaatgttactccaaagtctacaactcagtactaattatattaaaaattaagtgaatatctttctaaacaatcactctgctgatttatatctatctataggtattaaatatcccaagaatgtacagatatctccaattccaattcagtgttacagtattcattctagccttccctctttccttatgctaccttccttcttcaacagttaaaagtatggctttcattatctataacatatatacttatttgttcagtcctaatatgcacataaagaatcccacaattttcaacctatatctgtataaaaaacaagtttacttacttaagtgtagcatttgtgcacaaaaagtgtttgataaatttttctgggccaaaaatagcaactgtaggaaactgacaaaggtaggacaaagacatggttttccctcagatatccgcgtagttaactccttcactcccatcaggtagtgctcatgttcctgtcttctccgcagcctacgttggtggactattaatagcataatctcaccctccaccccacctagaccatcttgatcctttttctcctactttgtttcccatagcacttatcacattatagcgtgcatgttcaacatacacatttttttttaaagtgtacttttacatctctgaaaggtggattctgataatcaatgacatcataattcaattggaggcttgcaatgtactgtattttagatttaataagtcatggcacataatttgcttatttatcttacattctattttgcccaattaggatggataagttgacaaagtcaaagttattaaagagaatatcgtaactgctataagaaagcaaacctcaaatctcagtgcattaaaagaacaagggtttatttttctcttgtgtcatcgcaggcactctgttccacatagggaacagagcaccctctgttggattctctacctccagtcagcttaaaatggagagggttgaaaattacttaaaagtactgtattcaagagaaagcctggaattagagtttatcacttctgcctcgtgtctttttttttctgtattaatcagagtattctaattgctgtgatgttgtgggttgaatcctgtatcccctaaaaagacatactaaagtcttaagccctagtacctgtatcgtaatgtaatattacttgaaaatagtctgcagatgtaaccaagttaaggtgggatcatacaggattaattgggccctgaatccaatgcctgatatcttcataaagagagagaaacttgaagatggaggacacacagagaagaagttcatgggatgactgaggcatggactggagttatgctgccaaaagcccaggaacacaaaggattgctgccaatagccagaaactggaagaggcaaggaaggattctttcctacagccattggaaggagtatggccctgctaaccccttgatttaggacttctagcctctagaattgtcaaagaatgaaattctgttgttttaagccatttggtttatagtaattcattacacctgccctgggaaattaataccccactccttgtaccaaaatgcgtatcagcgttctctagagaaacagaagaaatatgaatagtgatgattaattagtatactgatctacattatactataatcacattatataatcatatcctatatgaagagatttattttagggagttggcttacatgattatggggtctatttagtctgagatctgtagggcaggccagctgactggaaattcaggcaggagttggtactgtatccttgaggcagaatttctttttccagaaaaacttcagttttgctcttcaggcctttagctaattgtaggatgaggccctcacaaactattgagggtgaacttctcttacttaaagtcaaccaattgtagatgttaaccatatctccaaaattctgtcacagcaacatctgaattagtgtttggttaaataactgggtactatagcctagtgaagttgacatataaaggtaagcatcacatatgaaaaagtaaatcaacatttttgctacttgacccaacaaaagtttatttctttctctcatcatggccaaatattgtgtctattggtgtggatggagaggaattctggcctccatatagccacagaaaaaattgggaatgaatttagaaatacagaacccatctcgcagctcatccctctagggctgcaggataattttaaaaatcacttgaggtcaggagtttgagaccagcctggtcaacatggcgaaaccccatttctactaaaaatacaaaaattttccaggcgtggtggtgtgcgcctgtaatcccagctacttgggaggttgaggcaggaggaacacttgaacctgggacacagatgttgcagtgggctgagatcacaccactgcactccagcctgggcaacaaagcgagactgagtctaacaattaaaaaataaagggcttcaagtgttatatgcttgttttgacttgtatacatgccagtagtgatgcctcatacagaacttggcttaccgaatgatcaatacacattaactctcttttttcctttcatatctgggaataaagttgatgaagctgcatcatctagcccaggaactagaatatatcttttttcttacattggtcagaactcagaaacttggctctgcttacctgcaagggcatctggtaaatatagtcttcctgtgtgcctgagagggaaatgaaatgttttgatagatacatcataaccctgtctttgctgtgtagggcttttctgctttgttcaatgttataatccaagcatctagaatagctcatacagtagttcctgctaattcatgagggacatgttccaaggccacagagaacgcctgaaaccatggatattactgaatcccatgtttttattttttaattattttcttagatacagcatctcaatctgtcacccataccagagttgtagtggtggtattatatgtcgctgctgcctcaaacttctggcctcaagtgatcctcctgcctcagcctgtggcgtagctgggactacaggcgcaagccaccacacctggctaaaactatattttcttttatacatgcacacctatgataaagttaatttataaattaggcacagtaagagattaacaacaataacttatgataagatagaataattataacaatatactgtactagacactatgtgaagatgatctatctctctcaaaatactataatatttttggaccataattgactatagataactgaagtcacagaaggtatatttgtggagaagatgggggactactgtattagactctgaaacatgcttattgcattagtaattgctatgatttgaatgtttgtcccctccacaactcatgtggaaatttgtcattataacagtattacgaagtgggacatttaagaggaattatgtcatgagggttacacccaccttatgggtgggacgggtgtcattctcaaaggacaatttagctccctttgctctctctgatcctctctgcccttccttccatcatggactgatgagcaggaaggcccttatcagatattggccagcccccaatcctagactttccagtctccagaaatgagagccaatatatttctattcatcgtaaattacacagtctgcggtatgctgttttagcagtacaaaacagactaatacagtaatgaaaaaggaaaatgccaacataaaatcaataataaatacaaggaattctgaaggaataagcttaagcatattagttattaaaataaatacaaacaactgaattctctcatctaaagacagatgttaggtgagcacagcaaagcacagctatctactgtttaaaagaaacacccttcaatgataagatggaaaatgaagggaagggagaagggatactaatcaaatgcatttaaaaaaattggaaaacataaagttaaaaagtagcaatattaatgagcagcgagatgcaagggaaggttaatgggatgaatcaggataaaatgagacattaagtaatgataaaagcacaatttatcaagatgatatccagccgttaaccaatataaacctatctacatagcaactaagtatatatggcaaaacatattagatttataagagtttgttgcaaacataattataattgaaacctccaacatatcatttgtcatagttaaatagatctatatataaatatatataagaacacaaataaattaactaagactatgaatgccataaatagctgggaatttaaatgaaattcctgcatattagcaaagaaaaataaatcacagacaatggcagaaattataaaagaaagctagctagctaatatgttctggtgagtgactccttttatgggcctcgtttatttgtttcaaaaacatttccttaagtgtctctttctaattaaatcccattatgcacaatgatggactctgtatttagtccttattgatacaatactgctgcactctctattaatccaaatatacagaagatgttgggagtcagagtgcagtgctggggaaagggctaaccccggatgccaaaactggttttgagtcctgcccttgttatcactgatgcaatttaaaatctctgatagttgcagtatgtatcttgaatcccaaactggagttcaagtttgagatattacttactagttatatgatcttggacaatttacttacccttattgagattcaacattcttatataaaaatggagaaacaatctctcgggatgcaagtctgtctacaacttaacaacattttacaggatagtacaaaatagttaatctcctaggatccaaaacgcctctacaatcttttttttttttttttccaaataagaagctgtatttgtgttagaataactaaaagactgatgaagacagtgtttgcaaaataaaataatgctttcctcaaaggaacaacaaaggattaattaaatgagtattaaaaaaaaagtctttgcttctatttctcaaatttcaaaaaaataggttggaaatttaaagggcttcacaggccaggagtggttgctcacgcctgtaatcccaacactttgggaggctgaggccggcggatcacttgaggtcaggagcttgagaccagcctggtcaacatggtgaaaccccgtttctactaaaaatacaaaagttttccaggcatggtgttgtgcacctgtaatcccagctacctgggaggctgaggcaggaggaactcttgaacccgggacgcagaggttgcagtgagctgagatcacaccactgcactccagcctgggcgataaagcgagactgcatctcaaaaacaaatagaaaataaaaaataaagggcttcaagtattacatgcttgttttgacttctatacatgccagtagtggtgcctcatacaggacttggcttactgaatgatcaatacacattaactatcttttttcctttcatacctgggaataaagttgacgaagctgcatcattgctcttactgtcataaccactgatgttatccctactcaataagcccttcctgaagaggccagatgatttccttttttacacttatgtcattattgaaaatgaggaattggtgatctacaaaataagttgtgatactggaaggaaaacgccaatgtgtgcttatacgtgtaaggcacaaggggattaaaaacatgcctgggcaggcaaaaaaaaaagggtgtagatgttaaaaatctttataggagaaagacagaagttgtgggaaatggataaactggaaatagaaaataaaaaggaaaaaaaacaaacagaaaataagtcaatgcaacatttgtctcaaacctttgcaatatatgagggagaaaagtagatatggaagagtataaatattttaacaaaaggaaaaaatgaataaaatgaaaagatacaacacagtggatattttatctaccttgaatatttctgtgaaatcgaatcacaaaaagtactaagaaggaatattaatgcaacctaaacttaaagctaccataaatacatacacacatatagcacactgagaagtgagtagacctcaaacttaaagtgcataagattaaccctgggaatttattaaacatacagctcatagaatttgcatttttatcatgcactgtagctgattctgatacagattgtcaacagtctatagttgagaaacactgtctggttgaactatacttcaacattacccccggagagatgaatgtcctcctagtattttcatcctgtttcatgggtgggattatagactcaggacaacttagagaactgaaaatcatgtttttagctatgcagcagataccactatactctgaatgaatactctgtatcaagcagaacactcacgaggcttttttctaaccagtggattttggctacgagagaaaaagagatagcaaacaagcttggcacaagattcagaagaaaagagacttgaagcctccctggaagagaagataagacaacctgcaatgcttagaggatatttaatttcagcattctgaaatttggggaattataatagcagatgatgattatgctctccacagatttattaaaatacattttaaaaaaatgcatttttatgaaacaaatagagcttactttaagggatccctgaatgattattatttttcagtatcaaatagaattcaaagaagaaagctgtttaatgttcatttatgaaggactgccaaaaattcaaaggtagaagattctctgcttgaaaaagcagaacaatcagcacaaatggaagattttgagagtaatgtcaagacggtgtgtgtgtacaatatgaagataataaaacaaatacataattgtaagcattgcatataatggggtataataacttctaaatacttcatttctaagaaaaggatatccacttataaacgatataaatctgaagttctcattacataaattctgcagtagtttggttttggagttgtggtgcaaacagaaccacatagaatatacaaaatacgcacctactatgagcgagattgtgcttgtgcttttatcaattaagataatgttcagctgcaagagccagaaaactcaattaaaccatggtttgagtaaattgtgggttttgtttttctgaagttgtgggaagtacagaggtgtaggagtctggggctgttacagcactgcagactcatcagagatccagttccttaagttcttctcatctaccatcgtagcatgtggttttccaaactcatgcagctgccttcgaattgcaggaaggctgctctgtccagcctccaggctgaagaaagagggcacccagcaaatggcatgtggcaattaaatctgtctttagaaagagcttttctgaaagccccatttggaaattatctgctccagtcttataaaacagcactgtgtcacatgaccaccctacatggtacaaagaaggctgcaaaattcaggattttagttggctacgttgacactttgaatagatgtggtacagtggcgagtagatatcaagtaggcaaatagcaatgtctaccaaattagatatattatctaatttaattgttttacaaattacatgcatttcatttcttcaatagatgaggaactgaaacatagaaatgttaagtaacttatctaaggtcaaacatggttactgaaaggtacagtctggtatgaaagcccatataattaaatgcgaatatcttttcccactatatcacattcctttaggtaccaccaagccaaatattttcagatggtaattttcagaaaaatgtgtatatcatgaatacttcagtcagatgtattttgatggtggagactacatttcctcacctgagactgaaaatttatttagggcaccgaccatgtcttcaacacttttgcattcccagtgcgtagtccagggttgtatcagtagaaaccttgagatgctggctaaatgtggattaagaaattgtattttaagctcacagaattcgacaagattttaaaattttatttattctaatatcctcacaaggttcacagagcatgttatagagtaggcattgagtaaatatttgctaactttaaataagtaattaaaatttgattttattgcgagatatcagagaaacatatatgcagagaaaaaagcatgacagtaaaaggagtagtttgtattagagtcatgagtttgacacaaagctcacagggagctggaaatgcatgaatggataaattggcctttgctgcacttcaatatgatgaatttcattgagtcactaaaaaatatttgttgagcacctactttatatctgacattgtgttggatgtcatagatacaatgaataaaacaacacaaacacgtccttgtggcttaaattttgtcttctaaagatgtatatgttatgtcctgcccaagactataggaatccaactcttgcatcaaggtaacccagatgtgaggacatggattcaaatgagatcattttggagctttatgatttgactgccctgctggatttcagacttgcatggggcctgtagtcccttcattttggtcaatttctccaatttggaatgggtgtatttacccaatgcctttacccacattgtatctaggaagtaactaacttgctttgattttacaggctcataggtggaaggtacttgccttgtctcacatcggactttggactgtggacttttgagttaaggctgaaatgagtaaagactttgggagactgtcagaagggcatgattgtgttatgaattatgaggacatgagatttgggaagggtggtaggcagaatgatatgatttggctgtctccccacccaaatttcatcttgaaccgtagttcccataatccccacatatcatggtgggagggacccagtgggagacaattgaatcacgggggtgggttttcccatgctgttctcatgatagtgaataagtctcacgagatctgagggttttataaagggtggttcccctgcacatgttctcttgcctgccgccatgtaagatgtgcctttgttccttctttgccttctgccatgattgtgaggccttcccagccatgtggaactgtgagtccattaaacctctttttctttataaattacccagtctcagttatatctttattagcagtatgagaatgggctaatacaagtcctaataccagtaactccaattaccttatttggagatggaggtctttaaacaggtaatcaagttacaatggggtctttagcatgggcgctaatcgaatataactgatatccttatcaaaaggggaaatttggacacagacatgcacatagggagaacaccatgtaaagatgaagggagagattggggcaatgcttctacaagccaagaaacagcaaagattgccagtgaaccatcagaagctaggagagtgacataggacagattctgcctcacaatcctgagatggaacaaacactgctgacaccttgatttcagacttccaccttccagaactgagagaggatacgttacttctctttaagccctctactttctggtgctttgttatggaagccctagataactaacacacagtgaagcccctgcctcacagagctttacattctagtgtggagcagaaaaggaaatagaaaattaccagagagacatggttattctttatatggtggtaaattgttaggagtaaagaaaagtagggtgaggaggataggaagtgctgctttatatgatgtgacctctgataagatgccatcaggagtgaaagaaggtgagagattgagctttgtaaatgtctgaaagaagagcattataggcagatgcagcagccagcccatggctctgaggaagaagaatgtattttggttagaagaactgctaagaggttaatgtggctgaattggatggagtaagggagaggggaaaggtaggaggagtgtggtcagagaagaccacatagattgtataggtccattttagattctgatggtgactttggcttctattccagagatgccatgggagggatgttcaaagcaaagggatagtgtgatctgatttaagttttaaagggatctctctgggctgtgtggaaagataacataggtagggagcaaaggtggaagcagataaatcagggagaagccttctgtagtaaaaccatccaggtgagagaagtggttggcttgaaccagcttgttggttggtagaagacagaaggggctacgtgaacagttagacaaagcattgcatatacaaggaaatgcttgacagaggaatggagacaagttttctagaggatgcttcaaggagtttccacttaggagaagcaccttagaggggacattgaatattagcactggaaggaagttggtgcagaagagaatttggcttgctgtagccatgcagtcatccagagcgatgaggttatcaaccattacaagattcactcctcccactcatgtctttgattgacatttctggtccccagcgtgctgctctcacattttggtccctgcaatgagcaaatgaatttcgtttcctctagtgaaagctcaatttgaacaacgggggaaaggttttatttaaatctcctacagctttgaactcatcttggattcaccatccatctgtcaacctgaaaaaagaaaaattacttaaaacaaaaattcaaactgaattgacaccaaataaaatatcaaatgctggtagcaagaatgatccaataggaagtgcttaacagcatgaaagctcaaaaattggttgaaaaattatttgcatctagctgtttaaatattttgtttagttgccatacaaattaccttattttagactccaaattttttaagagcaaaaaaaaaaaagaaatttaaaaacacagaagtttaaaataaagtaaaatgtaaagataacatgactttgagttcagtgagattgtatctaattttgaaatatagtaagttaattaaatagcttcttaattttgcagcaggaacaaatctcagtctacaaaatgtggggtggatgtgtgataactggccatagacatactgaatttaaagggtaaatacttgaaacctatcacctgagtttgaatcccagcactttttttacaagttgaggaaatttgttaacccatgcttcagctgcatctctaaaatgggaataaaaatagaaccgactttataatattgctgtaggttttcagtgagttaagtcatgtaaagtaaatagagtgactgccttgattaagccttaaaaacttaagctgtattattattttttattatttaaatttcctaattttctatttaaagttacatttcactggcttagagaaaagtgtaaacacatttcgtttatctaattccagcttcctgggatttgcatcaaactttgggaagaggcatgacttacacagggcctaagcattggtgctcttggaggacacggagcttgggggttgggcagattctctgtggtattgacgatccttgtcttattttcttctcattggagcaggaggcagggaaagaaatgcatggctcagcagcagcagcatgcatatttattgctgaaggtcttctcccagacattttggatttttttccatttgttaccttcacctagaaaatctttagtgtattaatctgcagagggcatctggtcctttgtctataccatgaaatctgttattctgtacctttatttcttctgagctaaggattggataacctcaaatatttttctctctctctttttattgccaagatctcccttccctaaggcaatggaagaagacatacaggagagaaggaactacaaataagagagatcaccttgaacaaaagttcgaaagtccatgaagctatatagtttttttctttttgaatttgttcatatgcttgatctgtgccaggaattgtcctgaaatttatgatataaagaaaaattaagcaaatcatttaattaaattgcgtactgtcacttggagaagatgggcaagcaaactaatgactataataattagagtggagtgtgatgagactcagagtatgtagatataaaacattccacaaaagaccatttgtagtagtgaccctctgtagggaaagatatgcattccaacattggttttacttgaagtgagttgataaaaatgaagcttaccagactgcatatgagcaaggcgggactttggaattggaaagggaatgtggggatagcactggagaagcaggatagggctgcagcaacactgatcgacagggaacactaaacaaggtggactgttttctgtgggtgaagtctgcgtgctttaacaaagtaagatacttcgtatcttaagaaaattagcactcgtaagtgggagtcgaacaatgagaacacatggacacaggaaggggaacatcacacaccggggcctgtcaggggcgtagggggaaaggagagggagaacagtaggacaaatacctaatgcacacggggcttaaaacctagatggcaggttgacaggtgcagcaaaccgccatggcacatgtaaacctatgtaacaagcttgcacattcagcacatgtatcccagaacttacagtaaaaattaaaaactaataatagtaaaataaaatacagctattaaaaaaaaagaaagaaaattagctcacctctctgaaactcagttttctcatctataaaataccatcactagcaaggatgctatgaggatgagggaggaggatgtcattcagattcccaaacctataatacgtagacggtagtttcaaggaaggatgtggattctattcgtttgccttggtaatggctaagtgatgtaaaattagaaatttctaaattcatccatacgtagcttctgacatctgcagaccacatcgaaaaggttatcacactaacggggtgccgagtggagtaattatttccagtcaaatatcttgaaaatacatatagaaagttaccaagactagaggagaaggtagtgggagcatgagggtaagactttaaaatacctggattcaactgagttcccaactaattattagacaatagtttcctccattgcagtcaacccttcctgatttttttctttttaaaagaagacatttaaaaaatctttttattggtgtagtcacttgcatgatggcctggtttgactgaggtgttagaatagggtaaggcaggattttaccttcctccaacccactgtaggtgatttgcaattcaatgagcaataaattatataattccaaatatggagtgtgtgtatgtgtgtattttaatggacatcttttggaaatgcccagaaaatctggaaaattatggcgccaaagatggcctgaatgaaagcattagtagaaattagtataaagtttttgcttagtcttgctttggctatgtgggctcttttttggtttcatatgaattttaggattgttttttctagttctgtgaagaatgatggtgatattgtgatgggaattgcattgaatttgtagattgcttttggcagcatggtcattttcacaatattgattctacccatccatgagcatgggatgtgtttccatttgtttgtgtcatctatgatttctttcagcagtgttttgtagttttccttgtagaggtctttcatctccttggttaggtatattcctaagtatttttttatttgtatttttttgtggctcttgtaaaaggggttgagttttttatttgattgtcagcttgattgctgttggtgtagagcagtgctactgatttgtgtacattaattttgtatcctgaaactttgctagattcatttatcagttctaggcattttttggatgcatttttagggttttctaggtatacaatcatattattggcaaacaacagttttacttcctctttgctaatgtgggtgccctttatttctttctcttgtctgattgctctggttaggacttcccatattttactgaatagaagtggtgagagtgggcatccttgtcttgttccagctctcagggggaatgctttcaacttttccccattcagtatgaagctggctgtaggtttgccatagatggcttttatgacttcgaggtatgtctcttctatgccagttttgttgaggtttatacttcccaaaagtatacctacaatgagaaagaaaattggtgggattatgtgaaaagattcaataagcattcacttgccatatgctattggaaaggcactagaggcggaagaaaatcacagttcacctaattaattatgatatagatatattgctactagttataatccaaggcataataattctacatgctaaatggagatcccatcatcattcatagaaaagtagagcaggtaacattatttcaggaaatcagggatagcttctggaggaattaggccttgaaagatgggaagagtttgttagaggaagacttgggagttcatcaggaaaaatatttaagctaatggaatggcaggaacaaaaagatgatgtgtgttgtgtacagggttctatttcggggagtgtgagcagaacagaatgcttggagttttggggaaaaggggagaaagggtgttctttattttttgttgtttaatctttcagtgatttcctatgaaagaactttaaaatgccagataccttctgcatttgaagaatgattttttttcacataagcagacaccattgtgtaaaacaaaatatagtaaacaaagccaaccaggctttaacgatggacaagcccgacttccgaagctacagtgccttgccactaaatatgagcctgacttgaagagtagttaacaaaatcattttttaaaaatgtgagttcatcttgtcttacctcacacagtttcttgatggtatcagttgctgcctaatttcctgagtcctaacctaagagtacctcctcctggttagggtctcaacttgccttcttagaatgaattcttttcactacattctcaccatggatcttctcttttcttaagtcatcagtaaagagattttctaccatatccactacattacagtatttggctgctctagatgaatatcttgggcagttggtccaggacttacaatcctctaccttgatcctttgggtagcctttctgtttggttcctctgtcttagacagatgggcaggagagggttcctcttctagtatcttcatgtcacaaggtgttatccatgacgggaagtgggggtgagttgtctttggcgtttctttagtggagtgcagctcagagcagtgtttcttaaaatatgtccatcattttgtgaagtggtattcgtcatgatgatattgcaatttaaattcagaagtgtgaataaaagcatggtattaaaacaatttatgaaccaaggcttcaatcattagtatgataactgcaaacacatatataaacacatggctgtttgccatgtaatccttctttcttttctttcatttctttctcttgagtagactttcccctattttattctaacccttccatctattaaccgtaaactcgtctgtgtgtcttttttttaaagagacagtgtcactctgttgcccaggctggagggcagtggcactatctaggctcactgcaacctcgacttcccaggctcaagccatcctcccacctcagccttcctggtagctgggactataagcacacaccaccatgcccggctgattttcgtattttttgtagaaatggagtttagttatgttgtccaggcaggtctcaaactcctgagctcaagtgattcgcctgcctcagcctcccaaagtgctaggattgcaggtgtgagccaccacgtccagctgtgtgccttcattgatactaatgtagattgaagctgaaaagataggaataaaaaaaaaacccagaacatgtggcagctattacaaagattgattaaattgatgttgttaaggggaaaaacccttaaatagcatctatgatagcattttagtgaccatggaaaatttaatattttttctgatagtggaccacttactcaagtgaatcctaaattatatacaaaaattacgtaacaaagacagccatgagttggaccctgttggataataatctagtgttttctagattccagaattgtagattcaagtgagtagaattggaatgtactttgatttgggggagttttctggaaacaattgtggatatcgtttttcaatattgaatgagttgccaccagaggtgtcatgttgcttggaatcatcaataactcagaagtgacagagaacagcctgggtatgctctgaaagacatatagatgtcacatgttgagagcttaaccagatggcatttttactcatgcaataaatacatattgagtgtccacaaaatgtcagactctgtgatagggtggagcaatgaaagagtgagaaaaagaaacaactacccttcagtcctgggatttgagattttttcccatcctaggaatctaggaatctacaaatatgaccttcagttttacacagaagcttctttttttaattgttaaatggggctcagttgcactactttacagcctaattttaaaaattagataaaaggatatgtgggctgggcacagtagctcacgcctgtaatcccagcactttgggaggccaaggtgggcggatcacttaaggccaggagtttgagaccagcctggccaacatgggaaaaccctgtctctactaaaaatacaaaaattagctgggcatggtggccgtgcctgtaatcccagctacttggggggctgagacaggagaatcacttaaacctgggaggcagaggctgcagtgagccgagattgtgccattgcactccagcctgggagacagagcaagactctgtctcaaaaaaaaaaaacaaaaaaaaaaaaaaaaagaaaagaaaaggatatgtgtagaagtgcccagtgacaaaatgcaagaattttagaaagttgataaaacatgagaagatcctgggagacacatgtgaatctcaagagcaggaactctagtgtattcacctgtacacagttactatcactagtgacagaaacaatagagaagtattttctttctgaatgaagaattcttctctataatggtaattcctattaaatcctttaatcggtaattgcaaaaatggaataagatttcagtctaatgctccaagatgtttgcactgcaaaattctacccattatttagtcaaaatccatctctgaggagcagcctaagcaaatgatctctccttaacctcagttgaaaccttgtcatgctatttcactttgcttagcagagtgctcatcttgagtttgctgtataccaatatgggggtgcagtctccatggctgcctgcttctccccatcctttgatacaaatcaacattcttgtttagagaatgataagagattattaaattcaggtatcagcagtggagttttggggaagaaaaataaagagatcatgctctgtaacacagccctgagaaaggagactggggctgtgtgctttctagaaaagtggttttccctcctgcatgactgatggcctgtctggtgtgaggctgaccatggtaataatgtcgtgacctactctccacagtggaaaaagctgtcggttctgatgtgatggaggttgggtgtgggagattgggattacagaactgcagtggccacagatagactcctgatttagtcacataaaacaggatgattttgtgtaaaactgacatttagtttattttacatatatggaaggaagactaggaagaacataaaacaattagcaggaattacttctaagagatattgagggaagtatcaatttcttttgattaatatgattttttacattccactttttatttgtgaagatgtataaatctaaaattaaatatacatgcccacaaaaataaaattatgtatttagtgacttagcgtaatttcataaagggagcatgaagtttagaatcagccctgcaattaacatcctaaattttgcactaaggataaaatgcttgaaaaaggatgaagtgataatatccctttctttttaggacagacattctaggattgaacacagctcctggaaaggagcttttctgcctcgctcaccaggagtgtgctcacactcttgacagttccctgtgctcctttcccactgtgggatttaaggccaaagagattggatctggctgccacactccttcctgctgccatattctcttagtgaccatcaaatgtcacgtcccttgttgacacagcactatgctctggaagcctttgttgaaccctattccgctgtcctttgacccttttactttttgaaatgtatatattctgtggatcccatgttttgttttctagcctgcagcttccctcagcaactacagccagagccagccccattcccttctcccctcctaatcagaactcttaaagtctactccagtctttcttagcttgcctgttttgctgtaataaactgggacatgcagggcaaagtctcaacacaggacatctcagcatcttgtccatactcttatctcggagcaagaacacacggacccactgttgatacctgagacaattatatttctttacaatgattttagaaactactagagcatgatgagctcaggtgttatggttagcaaatgtggaagactcaacttgccttcctcacaaaacctatttgctcttctcagttgcaatggactacctctacctggagtgtcaccagtgaaaaagttacttgacagggatctgtgggtggaatctacagagtgacagatttcagttcagttattaagataaagcatttataactgacatgttttgtaattgagtgggtggtttgctccacattcctatggcaagtatttcccagagcaggtaccttatatcggtagtcccactgggggctccatgacaacgcagctgttttcatcaagttggaaacgctgtcactgaattactgcccatggactctccacatacctaggagggaattgggggattcttgcagcagagaagcccatttaacttcaaggcagtagtctaacttttttttttttttttttttttgagacggagtctcgctctgtcgcccaggctggagtgcagtgacacgatctcggctcactgcaagctccgcctccccggttcatgccattctcctgcctcagcctcccgagtagctgggactacaggcgcccgccaccacgcccagctaattttttgtatcttttggtagagacggggtttcaccgtgttaaccaggatggtctcaatttcctgacctcgtgatccgcctacctcggcctcccaaagtgctgggattacaggtatgatccaccgcacccggccagtagtctaactttttaaaacacagatcaatattttcctggaacatgcttttccatatcccatagaccagggtttaaatgatcacacttgggacccttgtatgatcagaatcatctcgctccgttacttttagcacagggctgatgcttaaacccacattgtgtcgctttgtcccagggctgcattgcagtgagttcctgttcataggctgggtgacaagttaaaggtggcatcctgagattggaatcaaggcaacgatgttttcgcttgctctgttgcagcctgcccacctcgggggaatgtcagcagcccctttttgtcagcatataaacaagaggttttgaattgttcagtcatagagaattgtgaatgcgttagaaacacccaggccttaaacttcggttagtggttagataagaagaaaaagttcaagggaactattgtacaatgcggcaactatagttaataacaatgtatttgctaacagaatacattttaaatgttctcaccgcataaagataagtatgtgaatgcgtatgttaattaacctgatttagccattccacaatgtatacgtattccaaaatatctggttttacagcataaatttatagaatttttgttaattaaaaaatgtgggcttcaaatttccaagtgttttccaggaatttttggtgttaaaaaaaaacattcattttgtcttgctagacaggtacctagtcctaaaatcttaagaatgtttcagctctgcagcagagctgctggcatttattaagtatgttgctagttgtaagatcatttggttcaatgttgggcatattttcagactcaacaatttatattttgcttgctgtatgtgcaagcaaataacttcaactaggccagcctcgttgtgaagaaatttccccggtaaccaatgaagaaatattaatgatttgccagttggtctcctcggagacagataacagttgtcttcctttgtctgccccgctacctagcttatatttggcacttcatcaataaactaggggtgagaaagtaaataagtggtgcttctactctgcctgaggatacttgaaagcaacttgttctcttaagtggattaaataattcctccctgaagatctcattacttgataattttgtaaaaattagctttttctttataggaagggggtaagtaaactttgagtataactggtagctaagagccaagccggcctaggctccatcatgttcccagcacttatgggcaatctggtttagagaaagttagttcccctctccgtgcttccgtttcttaccagtaaaatgaacattacaacaatcttataaattgctgtgagataatatttaaagcagttcctggtacgcagtaagtgctcagtaaatgttacccactactgtataatccaaaggtgggagtgttccaaaacaaatgctaattttacaaataaaaattttggagtgttaaaaggaaggaagttatatgttcaaacatatgtatgtcatagataaaatcaaactgtttttgcttaaactatgtgcctcttcttccaccctaatatctgtgcagtacttgacacatagtttgctgagtgaatgaatgaactattaattaattaatcttcacctgtatcgcttgatgttttcctgcaggcgtgaatatccctgggcatactgcttgctttgagaaatagccagtgaagggttatgagaaatagtgcgatttatgatctgtgtatgactcaaatgacaaaattaattgcttttttgtcatctgttcttcatggattttcattaattcttccatatgaaccaaatcctgtcttaaaccctgcagtaatgatcacggtgtttaacattttaataaaacgatggaagcatgtatgtgtgtgtgtctgtgtgtgtgtgtgtgtattcatgacaaagaaagtgagagagagagaaagaaagagaaaaataatttacatgagagttaactttttatttgtatgtccagtggtgtcagttgccatgaataagctattataaaaaattaataaataatttcccattaaaatacaaaaatataaatgccatcttccttgagagtatttctgaaagttaaaaactctaataattggataacttttctgttatgttaaaagaggacagtttttctttcccttaagaagattcctacttatcctattcagtgtttgaataatttccaaattttgatttctgtctctgctactggtcataaacatattgaggtttcaaaacattcagattggccctccattaatcaaacatgccactcatttcttagcacaatctacagattcacaaagcccgatgctccatatcccttgtcacatccggaggcagagcattgaagttcatggaagaaggaagaaagccatgcctgagttgcacctgccagcaaaacagatgacaggcagccaattctgagccatctcagctgcaccggaaagttcttgttcaaacaggctgtatctaaagactttctaattaccctctcatgtcatggaacacctgtggtccactgtttgagatcctctgctccctgatttctgtacacttgcctctcctggtttccttcctgcaacctcctcttctgtctatatgaaaaagtttagtttttattcccagctgttcacaaatattatttttagtgtaatgataggtaatccttattttaaatgtcacaactctagtctctctccaatgtcctaggtaccacagtcaggaagcttcctatttgcataagaatgaaaacatggtcttgaggcaggataagtaaggttaggacccatacttacttgtcctgtgtgtaaagctcagtgggccacttttatagctggctctttccccttgcaccctcaggcatcaacacctaactcttttgcaagataagcggtcctaccgaataccaacagactgttagatggttacaagttcctgatactcagtatgggcttggggaagagaacaaaagtctgttattcctgatgtaacttccccagcaccaaaagcacaagaaactattagctacaaatttctgcctgctgggcactgagagaggggcagagactcctccagtgtcccacaggcatagctagactcaaggtttagcttatagtaatatttttctcattttaatatcaaaaaacaccccttagatggagattttatatgctaatgatacatatgatatgtgttagagcatgtagatcctgagtgtatgtactaaccacagatccacctttacatacttgacctcaccagtattttatgaatatgtctgtacagtttccgtaaaggaaattcccttcaagaccctaggggctatctctgtctttgagcagcccactctgcctctcagattttgagagctaatcccaagtaagagtagacaaacaagtttgttgcacctcactttgcaatactttcgctttgatataaacttctttgtctacacttacttgggattcgctctcaaaaccttttgtgcagagaagtcaacgacctgaacaaggctactgacaatagtcttgccaaattttctacaaactccattcttctttatttttattttattttattttactttaagttctgggatacatgtgcagaacatgcaggtttgttacataggtatacatgtaccatggtggtttgctgcacctatcaacctgtcatgtaggttttaagccccacatgcattacgtatttgtcctaatgctctccctccctttgccccttaccccccaacaggccccagtgtgtgatgttcgcctccctgtgttcatgtgttctcattgttcaactcccacttatgagtgagaacatgtggtgttcagttttctcttcctgtgttagtttgctgagaatgatggcttccagtttcatctatgtccctgcaaaggatatgatctcattcttttttatgactgcatagtattctatggtgtatatgtgccacattttctttatccagtctatcattgatggatatttgggttggttccaagtctttgctattgtaaatagtgatgaaatgaacatacatttgcatgtgtctttatagcagaatgatttataatcctttgggtatatacccagtaatgggattgctgggtcaaatggtatttctcgttctagatccttgaggaatcgccacactgccttctacaatggttgaactaattacactcccaacaacaatgtaaaagtgttcctatttctccacgtcctctccagcatctgtcgtttcttgacttttaatgatcgccatcctaactggcgtgagatggtatctcattgtggttttgatttgcatttctctaatgaccagtgatgatgagctttttttcatatgttttttggtggcataaatgtcttcttttgagaagtctatttatatcctttgcccactctttgatggggttgtacaaactttattctttgtattgcacattctctccctcctaggagcaagtttatgggtccatggcctcttcatccagtgcacattttctgcttttccattatagcacttattacaaagaatgaccatagctttttctccatggtctctcattcatttctgagctacctgagaacaagaatcctttctttacatgaaagtgtgcctgatatctatcaccatgtgtatgatgaccacagagtaagcagtcaagaaatgccagggaaataaatgaatgcatctactttttagaaacattgtcaccatctttctttatgtaattaaatgtgaacggttcataaggcaaattgataaggatagaaagtagattagaagttaccaagggctgggaggagggatgaatgaggaattatggattagggggcacagagtttctgattggggtgatggaagaatttggaaaaaaggggtggtggttgtacaacgttgtgaatgtatcaagttaacaaaagtaatggcaaaaaccacaattacttttgcaccaacttaataattaatgacactgagtcatgcacttaagcatggttttaatgataaattttatactatgtatatatatatttttttccaaataaattttttaatgacctatttacaaacacaaaaggcattgaaatctgggtaactagatgcatgttttctaaaaggaaaagcttatttgctaaataaagaattcataaaaggaagctcagcaattagtcttggaaacaattacaatggtagcaatagttttttcccttattctcacttcagacaaatattatggcaacagaaaaaaatgttaattaatgcaatgaattttaaaagtgaatgagtgaataactgaatgattaaaaaaagaaccatttaaatagaggaacatctgaggttgaatacttgggtccagcccagtacagttcattgctctgctgatcaggcagatgttagctggtcaggatggtttgcattctatatgcacgtagaacagacatggacacacatatttgtgtttggtaggatgggctgtcaattcgaatagtcatggggcttaacggtcagatcaaccaaattggtgccctggaagtgtctcagattttgtaacctatgtaagagttttaatctcactgaagcacagttttctcatctaaaaagtgaaagagagagagaaaaaagtccaacatcattgctttttttgtggaggtaaagtacacctgattagggcctggcatgcagaaattccttgcttattcacttttatttttattatagaggttcaaataaattcatgttgaacaaatagttattccacataaaatattatgcattctgaaaagaatattagtgccagatgttcatggtataacaatttttctttttctttcttagctaaatttatacttagcattcttcatgatgtatgcaatattagttcatctaaaatctaagctatagctcagaggctttgggggaaatactcatcagtgttcagagtaactctactgttggtgatctgtaatgtatcttttctaagcaaacataggggttaaaattgaggctgtgccttgccttggagggttagtcttatgagcactgatttccatgtatagagctttttctaacctttttctctttttctcttccccttccttccatgctgactttggtgtagcagaccacttggggattgaattcatgggtaagactaaacaatttgctcatttaatatcctggaaatgctaagctttatgatgtacatagtgctttccttctccatctggttataattgaaatgtctcattatcagatgctattagtaggaaaaaatactcttgtcgagttttcactaagtaatggctcaaaatgaaataattaactacttattggaaaggcaatttaatgttaaatgcagtgtctggaatcatacagaagttgtatttggctcctggctttgattatttcctctaattctcaattttcatatctgtaaaatagggataataataggttctattttcctgcacatgtaaattgcttagcataacgtctgcaacatggcaaacactcaataaaggataaaaagcaatggtttttaaatgtcagtttttaaatttttacttctaagtccccttccttttgtgagatgattcctttggatacattttggtatcaattttagtttggagtgtgggctattaaacatttttattcacaaaattaaaatgtttcctttaaagtatttgcagtgaatggtgtatgtttcaaagcattagaatgccttccatgggcattgtttttatagtcacagataactgcattcaaaattagacctaattctctgagtcgatggttatacattaaatgaagaaagaacatttcataaagttcaatatgcatcgtagtacatggatggaaagacactcaggatttagagttagggaaattgagaagatctaaatttgaatcaaaattcatctgcttctttggattctattaaattcagatttttttctcttgtataatgtggatatgaatacttgctttatacatgaatgtttattgtgaaataattatatacttacttgtattaatttatccattcacccattaattcagcaaacacttatcaaagtgttgatttgggatagctttgacatatttgagagacgttaagttggtggttgtattgttggaagtgttgagagttaattagaaatttgtgaaatgtctttataccggaattggtgttcccagttgtatggtattactcattattgctccattctctggttattacatcatagaaaaggcagacagctcaattcctgcaggcttgcggttttgttggatagatgtgatgaaaactcagaaaaccaatgagatttaggatgttattcaaatgaagcgcgatggaatgtgagatagttgtagaaggaagtgaaagaagaatgaccgtttcaatgaaatcaattagtagtcatcatgagagcgcttgaacaagctggtgtgatgaagagattatagtcatatggcagattggttgattttgattttgaagatggaggagttataggagatgacaatattcaaagcattcctatgagtgtaaataaccaaactgaggttgagggggaaataatttgaaactagaggtcaaggacttgagaggacatagttttggataagttgtctaatggatattccagttactcatgataatgctagggttgggacagagagaaaaaaaatgttggttatatgccaaagtttcccattaatatgataaactatactggaatttagtagatgacaaggaagagtatagttaagggtaatgccagctgcatcaaaaaatagagcccacgttattataatggctcaaagacggtagcaatttatttcctgatactactttttcttgtccaaggtagatgtatttcctgtttaaggtagcaaatgactagttttattcaagtagtgaattagagatccaggcttcttccatcttttggtttcaatattacgtaggtttctttgttaactgcatctagccagcagattgagaaacagaacagagctgatgcatacccaatgcttaaaagactgatctacaagaactcatatcactttttgcttaatgttctattagctagagctaaattacatgacttcattttgctgtaaaagaggctgggaaatggaaccctgagagaacagaggaaatgcatttttagaaatctctgccactgtgtgaatggcataaactttaaaggaacaggatttttcataagagacaagagaaactgtacgttagaagccaggaggacagatctccaatgttgaaagtgagaaaataaaaacagctcttgagacaggtagaggaaaatgagacttttcaggcaagattcaagtttcagctaaaataggagaacaaaaataaagagtcaaagaagagattgagaatgcagaaggtgtgttgcggaatgtggatgagcaatttcactaagccaagtggagggtataactggtggaagaggagtagatagctgagtcatgggccacaaattactgaaaatcatgggcatatttttgcagtaagaatacattgttgagaagggcacacaatttgtaccctcctcattcgctaatgatggcagtgattcgtagcatggaggtgtgagcatcagtactcattttgaataaaatgtgccctgggccgcttgtccaagagcaatttgccccactagtctgtggtgattgcaggctcagtgaggctttataagttgttcagcagaatgccctcaaatgcaggaaacactgcatagttggtggtgggactaggataggtctagatccccagtgtagccatggctgtagcaaactaaaattgccatgcaaattttaatccgtgttgaaagaaatggaccagtctccatcctgttgtgcttcctattgtgtctgaggactgccagtggcactggtaatttatagagttataatttgctatagatgcaatctatgtattaagagctctgttttggaattcatttaaagaaatgtagctactgacacaggaaaaaatagtagattgtcatgtagttcatctacatgaaccacaagactaaggtaatagtgagttttgcaaaagatagattctaatcatagctataagacctcatggggaatgaattctcagtgggtgactatttgactccaacggtagaaattttcttggagggaaggggttggggaacaactcagagttcaagggattggctggtatgcatatagataatggcagctaaaaaaggattgtttgcagtagtgaatagctttataaatttagtgaatatgctgttttcactgacctcaataattcacccccacagattgttctaattgaatatgtaaaattctgtttgttgctttgagaacaatattctcagatttaacttttttatttttattttttgagatggagtctcactgtattgcccaggctggagtgcagtagcacaatcttggctcattgcaacctccgcctcccaagttcaagagattctcctgcctcagcctcccaagtagctgagattacaggcgcctgccaccacgctcaactaatttttgtatttttagtagaaacgggtttcaccatgttggccaggctgttctctaactcctgacctcaagtgatctgccctcctcagcctcccaaagtgctgggattacagacgtgagccaccacacccggctagatttaatttatgattatagaatccatatgggtaaaattccttccactgaaagtgccatcatcccaagtaatatgacatctctaggtatgaattcagctgggaaggggaaatgtaggcatagtctatatgtaagtttaataatgtcagtttattgttgtgccaacaattaatcaatgctagttctatttgtgtgtgtgtgtgtcaatttctttaatagacttgattttcacacagttttaagttcatagcaaaattgagtgcaaattacagagatttctcacgtatcttctgtcttcaaacatgcacagctacctccctaatgaagatctcctacaatagaggtacatttgttacaattgacaaacctaaacctacattgactcatcattatcattcaaagtccaaagtttacattatggttcattcttgatgctatactttctatagattcagacaaacatattatgatatgtatccattattatattatcctacagagtaggtttactgccctaaaaatcatttgtgttctttctagtcatccttgcctttccccaaccactggtcttttttatttattttattttattttattttattttattttattttattttattttattttattttgagacagagtttcgctctgtcacccaggctggagtgcagtggtgccatctcggctcactgcaagctccgcctcaggggttcacgccattctcctgcctcagcctcccgagtagctgggactacaggcacccatcaccatgcccggctaatttttcgtatttttagtagagacggggttttcaccgtgttagcccggatggtctcgatctcctgaccttgtgatctgcccgcctcggcctcccaaagtgctaggattacaggcgtgagccaccacacctggccccactggtctttttactattgtcatagttttaacttttctagactgtcatatatttgaaataataccttttgtactggcttatttcacttagtaattttctcatgtgttttcattgcttaatagctaattttttgtatttttagtagagacggggtttcaccgtgttagccaggatggtctcgatctcctgacctcgtgatctgcccgcctcagcctcccaaagtgctaggattacaggcgtgagccaccacgcctggccccactagtctttttactattgtcatagttttaacttttctagactgtcatatatttggaataataccttttgtactggcttatttcacttagtaattttctcatgtgttttcattgcttaatagcccatttctttctagagctggataacattacattgtcaccttttgaaggacatcttagttgtttccaacttttgacaattatggatataattgttgtaagcatctttgtgcaggcttttgtatagaaataaattttcaactttttggtgtaagtaccaaaaagcatgactgctgggtcatatgggaaggatatgtttagtttttttagaaactgccgaactgaattccaaggtggctgtgccattttgcattcccaccagcaatgaatgagagttcctgttgctccacatggtctccatcatttggtgttgacagggttctggatttgggtcatttcaataggtatgtaatggtaactcactgtttcaatttggacttcactaatgacacttaatgtggagtattttttcatatgcttatttgccatctgcatattttctttagtaaggtgtctgccaaggtctttggcccattttttaatcagtttgttttcttattgttaagaattctttgtatttttgaaaaatgatcctttattagatatatcttttgcaaatattttctgtcattctgcggcttttccctttattctcttgacagtatgctttgcaaagcagaaattttcaattttaataaagtccagattataaaatcttccttttatgtattgtgcctttaacactgtatccaaaaagggattgccaaatctagtttatctaaatactctcatatgtgatctgctaggagtgttatagttttgcattttgcatttaggtctgtggtttattttgagttaatttttgtgaagagtgtaaggtctgtgtctaggtgcatgttttattgaatgtggatgtcaagttgttccagcaccatttgttgaaaagtttatcttttctccattgtattgtcttttctcctttgtcaaagatcagctgactatattaatgtgtatctattctgagttctttgttctgttccattaaactatttgtcttttttttttttgccaatactatactattttgattactatagctttataataagtattgaagtaaagtggggtccgtctttcaactttgtcttttaatgttgtgttgacttttctggatctactgcctctccctataaatgttagaatcagtttatgaagatacacaatgtaacttcctggaatttttattggaattgcattaaatctataaatgaagttgaaaagagctgacatcttgacaatattgagtattcctattcacgaacatggaatatctcttcacttacttgggttttattttttaagtctttcattagtgttttatcattttatttgtatacatcttttattttgctagacttatacctagatatttcattttgggggatgctaatgtaaatgctattgtgtttttaatttcatatcatatttgtttattactggcatctaggaaaattattgactttacatgttaacctagtatcctgttacattgatataatcatttatttgttataggaatatttttaatttttaatttttgttaacctaagcaatcaggtcatctgcaaagacagttttacctcttccctttccaatctgtgtacattttgtttccttttcttatcttatttaattcgctacaacttccagtatgatgttgaaaaagaacaatgaaagggggcaactttgcctcgttcataatcttaatgagaaagctacaagtttcttatcattaaaaattatattaggtatagatattttgtagatattcttcatcaagttgagaaagtccacctctatttctagttaactgagagtttttaccataaatgggtgttggattttgtcaaatgctttctttaaatctattgatatgatcgtgtgatttttttagtctcttgatgtgatggattacattaattattaatattgaaccaactttgcatacctgagataaatggataaatgtcacttggttgtgttttccattgttctattttaattagttacataatacattttttctcttacttttattattcttgctttgagcaatatgactttcatttattcttgaagaacacagggtcacaaggaggtaatgatctgaagcacacgtcttcttcccaaatctttatactctcaatgaccagctctattagtgagcttactgatcagtctcaaaaccagaatacttcatacagtttaacaaattcctgttttatagcaggaaactccaagtcatatgctgcaagagttctatatttaattgacatacatttgtcacatttactatatgccagatgtataagatgttggatatgcagatatataatacatatctctggatgtccaaaacctctaaaactaaaaagagaaagctacacataagtgaggtgacataataagtgctctaaaaaaagtttaggcaagatacgatatgaaaaaaaaaaagaaagcaattgaatgggcttggaaagttcaggaacagctttccaggaaaggggacacttaagctgagtatcagccaaagtggataagctatacttagtaatgccatagtgcaaatctataccggccccatattgctcccacattaaagcaagacttgctatttcagtctttcttcctgtatctatcagcttccgagagtcaccactttaggaccggaaagaggataacaacttcagtaaaaacaagtaaccaaaaaggtttttgagtagatttattaattttaaggagtgattatcccattgaggaagccatgccaaacctaatgtctgtaaaactgtcaacattcaacatgatttttcatttatattcccgaatttttcttaatgatgctcctgggattggtaccatggaaatttcaacagcaaatactgatctgcaatacggtgtcagttaaaaaataaagttaactgacataattagagcagaaatttggaaatgcacacagaagcagaattgtgtttgtgaagtttttgaaacaaagagagttgatagaaaatcagtaaccaaaaatatatatcttaaattcatgtcttaacctcattcattcattcatgcatgagggaaaatatagatttttacagtcagatgtttgaaatttccttaacagtttgaatagatcaagagatataattgacagacttcttcataagcctaaatattcatgagtgatgtgagaaacaaccaatcatttagtttaggcagttggccaaagggcatgtcagactggccattttggaaggtgcaataatcacgaaggatttcttatctaacaaatatctagctactgtgtgtgaaatgtatctcattaggtccttttgagctatttgttaagtggttatttttctaacaatgtcttgatgcatttgatgttccaggcatcaaagatgtttatatgaaagcaggtgcaatgccatttgaaaatgtattagcaagggacaagtagagttgaagattatgtggaagatctttaatgcaaatttccttcattctcatcgggtaaacgaaatgaatgctgtcagttaaatattttgtcggtgatttgacattgtttttaggatagcataatatatttatgcaaagtattgtttgagcaaattctggtgtaattttttaaatcaaaagatgtatagaacatagaaaaataagattcttaattaaaatcttaaaaagttattataagataatctttgtattttttaagttaaaaaaaaaaagaaacagtgttttccatatggaaggcatagaaatgtgttgtactcaacgtctgtgatataaattatatttataggtttagaattgatagaatattacttcaaacttgatcgtatattgggtattctttcatcctcttgtgtaaagaaaataggctttagtgtattttagtgagcactggggataatctcctaagaagtgaccagtttaggatcctgtttagatgataggaagtgggcttttttcttcttagagctaccctgcatattgtaaatgacttggtgtttttcctttaaatctaacaggctcatatgtcagccaaatgaattcatatttctgttctagtttgtgaactggcgttagagatagaactgaggattcttttttcctaagctgaagtctctgaagtagacttatttggaaaaaaaaaaaaaagcattttcattcatttgaatatattatatttctgtatagaataaaatggtaatttatggatatatatgcatagatgtgtgtttgtggaggagtgccattaaaagagtttagttttgctagtgtgccctttgccatgttaaactacgtgagaaatcagatatagtggaaaaacaaaagttacatgatcctttaagctctcaaaatgagtgaatgaagtagtaactatttatatcgctatcttacaaatgacaaaacctgactactaattagctgaattatctttctaaagagcaacaaagtagcagataggagttgaattcaaatctgtctttctccagagctcttgaattatttaggtgactaatggatgagcaatagggctccatgtttcctcaaagaggttgtactcttgcagtgtttcaaatggcaaagcagttctgtgactagtccttagttttgaaggtaatgttttctgaatcccttcatgtcataaggatcttggccagtaactcacaattatccaagctacaagcaaatgaaatatgaaccagatcctgtttatagctatatattcagaattataactgccaacagtataaaaaggaccacttagctggtcattgtattctctcacatggggtaatctacagaagttgtattgtattgaaggttttgtggtgagtacagactgtgttgaatgaagtcatttgggtggttctactgtacatgccattggggtataaaggccttactcatttatctcctctgatagaaaacatttgccaaattaaatcatgatttgaaccatctctccactggctcctaaagattctattggagaagtatttaatacttacacaatattgttttctcatttattttattttaaggaatatgaccactctctttctattttttatttttcaaggcagggtcttgctctatcaaacaggctggagtgcagtggtgtaatcgtggctcattgcagtcttgacctcccaggctcaagtcttcttcccattttaacctcccctgtagctgggaccagaggcatgtggcaccatgtgcagctaattttttatttttttgtagagatgaggcttctctatgttgccaaggctggtatcaaactcctgtgctcaagagattttcctacttcagtctctcaaagtggtaggattacaggcgtgagccaacgtgcctggcccactctctccctttacactttgattttctgttggtttattttaacatgggcttcagtacatgcgctgttaatcacaagccctccaagtattttgttttaacaaagttatctttatttgacatggacattccaaagactcccaagccatacatataaggataatattttggcttaattattaagagtagtcattaacacatattggtacctcctattgggagaagtaaaagtgtttacacaaagtcatgacaactaagtcaaataaattcaattctgagataattttcgggtgagattaatagtgttcagtgatctttgaaaatgatacaaccaaaagatgtattgaagaagtatgcagatctattaatcatgatttctacaaagaagaacatgagtatttctgtaaagatgtttttggacaagattttaaaatcagctaataaaatttgattggtagacactgaggaaagtattgaactattggcaaaagcagtgctgttcactgaagaataacataagaccaatacatctttgctagattaatagtataatattttccgtaaagttgttaaataactagattggaagtttctacgtaggtgtgaatatatggactttagcaaaatcttgggcagaatttcatgaatttcttatgtaatatggtgaaacattaattatgtagtaattatatagtgatagatagatttggggcaatgaattctagttgaaggatcaagaccagccatgagcagagcttctagtttcttctaaggaaacatttttatgaattgaaataagggtatagcttgaacatttaccaaattattgaactttttgtaaaaagtgaatgcttctttgtcagagagcaagtctaacaaaaagcattggacattggacttatcaaatcagacacagaataatctgatcttttagtcagtatcaagttgattacttacatatgccaaatatctcaactgcacgtgagttggtagtaggttctgaaaatctgggatgtgctaaaataaagggaaataaagagcaacagtgatgttcagattgtacttagaaagtaattctcagagagagccaggcatggtggctcacgcctgtagtcccagcagttgggaggccgaggcaggtggatcgcttgaggtcatgagttcaagaccagcctgaccaagatggatgaaaccccgtctctaataaaaatacaaaattagccaggtgtggtggtgcatgcctgtaatcccagctacttgggaggctgcggcaggagaatctcttgaaccctggaggcagaggttgcattgagccaagattgtgccactgcattccagcctgggcaacaaaagtgaaactctgccaagaaaaaaaaaaaaaaagaaagaaagtaattctcagagttatcagagaagttaaaaaattgttttttatatccaattctgccttacagttgcttcaggagctaggataagtcagcttaatagaaaggggaagaaaggacaatgatggaacatctgcagatgcagcaaagtgaagatgatacaggttcttctcaataagcagagtctgtctgctttgtgggctcatgatggttcagccagtcagaatgtgttgagcccctgtgagagctcaggccttgtaccaggccagctacaataagtcaaatgagacagactctcaagaagttcacagttcagtgcatagggcagactttttttttttttttttttttttttgaggcagaatttctctcttgttgcccaggctggagtgcaatggtgcaatcttggctcactgcaacctctgcctcccaggttcaagcaattctgcagcctcctgagtagctgggattacaggtgcctgccaccacacccggctttttttttttttttttttttttggatttttagtggagacagagtttcaccatgttggccaggctggtcttgaactcctgacctcaggtgatccacgtgcctcagcctcccaaagtgctgggattacaggcatgagccacagtgcccagccacatgggacagacttttaaaccaattattgcaattcttgcaaaaaagacttaaattgaagttttgttttgttttacaaaaggtcagatgaagatgtcccaaacatatacaggatattaatatatgtttgacacacatgaacataaataggagttgagttcacatacatgtggaaaacattaggttctgtacctctactgcatagcttcacaaagtcttaggtgtattctattcatctgtgaatcttggagagaaatctattgtaggcaaccttttttgaactatttgtccaaaggagcatatatgctagagctacggtttagggtaaatcctgggataaagggagacagaggaaggagcacccacatacatcagaatagttcgggccatttttaagtgaaagaataaaaaattatatttctacagttagtagctggagaaaggaaatatgagagagagggaaaaggaagaataaagggaaataagagatggaagagcacatttgggaaatggcaaggagtcccagaactggacaaacttgatgtagttggtgaaggggccagagcagattatgaccaccctatctgccctttgaaataagtataatcttatctcttgttgaagaagaaaaccttctgaggtttcaagcagggaagtgatgagattttcttaaacagcttactctgtcagtagctgtgtgcagagtttgcctgaaggcactgatcgcagaatcctagctaatggaacaaacttgggattttacttcaaatattcaccaaatgctagccctttaagcaaccctgtggacattagaaggataaattttcatttagtctgtgccagattcagagaaagcggcaagtgcagaatgcctggggaggcagtgagatgagttgcaaagtggaccttgaactggtcttcgaggaaagagcacttgatttttatgggcagcgatggaaacatcctaatgaagatgtcagcgtaaacaggacgaggatgaggcaatctgtttggaaatactggctctcatcagcaaagggaatcacattataatttaatttggattacatataactttttccttaaaacatccataaaagcataccattcccctgcatgaaactttttaatggatttagaatgaaatctaggcactatctgctgccatgccaagtcctccatgatttggctctgcctggcaccctgaccactcctaccacgttattattctcatttctctacctaccccagggcctttgtcctgcctttccctcagcactagctattgtacttatctgcacgtggttgattccttctcataataaataattcaattaaatacattctgtaagagacttagcctctctattttatgtacttcctattttattcatattaacttcttttgtttctccactgcatttattaaaatctaactaatttatgtgttcacctttttctcatcagcctcttcactagaaaataagttctgtgatagtagaacttgcttgttgtggatctccagcccaatgcttagcataattataaaagctcaatgaatacttatggaaataacacttttaaaaataaatgtaaatagtatatgtttttcttaactcttaagttgcttaaatgtctaaaacgtataagcaaacccacccatgaaacacaagaccatgcaatttagttctagattaattctcaatcagcgatcttctttcttgagatttcctctgcttaagcagtagcatataaaaaatggtattaatctaatgaagactttttttttttttttttttttttgagacggagtctccctctgtcgcccaggctggagtgcagtggcgcgatctcggctcactgcaagctccacctcccggcttcacgccattctcctgcctcagcctctggagtaggtgggactacaggcgcccgccaccacacccggctaatttttttcgtattttttagtagagatgggggtttcaccgtgttagccaggatggtctcgatctcctgacctcatgatccgccctcctcggcctcccaaagtgctgggattacaggtataagccaccatgcccggcctaatgaagactttttaaagttgaagtttccagttcacttagtagtactgagggttaaaggtgttaaatattaatgtttccaacaggattggaacacagcttagggaagtcaagtaaatttgcttatccagtgaggtcgcctgtcttcatgttgcattcactcttctaagaaggatttcatccctttttttttttttttttttttttgcatgagaattgaagcagaagcttgtgctgtattgaaagtatattgaatatgggctccgtttattgatgaagctttcaagcactcaccagttaggaggcatagaggaaagagaatgaatgttcactattatataagttatgggcatggtaggtgacttcacaggagttatcacattttgtcttttgaagttaccagggatcttaaatatgtgatgtatgaaatcgccataacctgagtgacctaatctttggtttggggaaaactgctcctgtcttcattttagtatccttgggaataccagatttggggagctacctagtatgtattcaagaaagctgtccatatttagagtgcgcacgagtgagactgccattcgtggaagagaaagacatagagcttcagggcacagaaagttagtcttttaaaaaagcctcttaagggaatttttttccactatatatgtgaagaaataaggctgatgaaagtaaaagtaatatgcccaactgataaatagtaaagatgaataataatccagatcaaaatgtctctaaagcttgaactattcccataatccttccctaggagcataatataaaatggtgtgttttctccaaatatgatgatatcctactttgtgctgggctccaagcacactgggccagggccataactacactcaactaggccctcagctgtagaaggtatatcatgggtaggctggccagatttagtcaataaaaatgcaggacacccacataaatttaaatttcagagatgtaacaaatacttttttaggctagatatgttttgtgtattgcatgaggtgtatctataaacatcgtatttgttgtttacttgtaaagccatttttgagtattttatctggcaacccctgctgtagggccatgagcacagtaaggagtggctccccagtgacccacttctatctcacactccagttcccaggaaggctgaattagagttaatatgagcagtgcaggaagataagcagaattaatgaggaaacttagcaaaaggggttggaataagagtgtgctttgtgtcccaagggacagctctgcttgttacacgatgagaattatgcacaaaatactaaactgttcccaaattacctcagcaactatggttgtttaacaaggcaaacacaacctgcaagctcattggttctgggcaggatggatcctgctgtcagagcaactgatgaactattttaaagccaagttcctattgtgagtgaaatagattaacacttcagatatggatgcttcaaaaaacaaatagcagcatgctaacttagttaatgagtttttgaggaagaaagtagcatttaacttaccaaaagatgcagttcaaggctatattaatgaagtaataacagctgtgtctttatctgttcactacccattcattttctcattacattcagactgctaacttcagtcacaaacatgcttgtatgagaatatggggccttttgttcctaccagaaaataatcaagatgtctatcttctagagttgtactgtatcatagaagtgattcaatgattctgcttttctatttctgtgagaaaaaggcatgctatgggattcaagcactgtaataaacacacacacacactgaagccaggtggacatttatcaaattttgacttcatctcctatatgctgtgagacatgggctatctgcctagctatatatctatgtatttatgtatgtgtgtatgtatctatctatatcaatgtccaccgctgatggttcattaatataaagattgatgatgtaacaccccacatatgcatttcttgacatacaggcattcaaactatgtttttcctttcttcatttcctaatgtgctacactgtgttttcctggtttactgagtatgcctgtgtgtccagaaaccctcaaggacagagctgtgtgctttaggagtcttcctcgtttttgcccctggaacagtgccaaatactatagaattttagttgcatcttgccacaccacctggctaacctcatctcatctactcatgcctttctcaaccattcagaagcacgttctcttcttttaacacgccgtgattgtccatgcccgtcttttctgcatgtgatttctatgtgccatgacacttaagacttaccaccctttcctaatacatcgttcatgcagatctgcattcttagtgtataaggcgcttatgtgttctactgtaactttgctagattatggtgtcaccatggtttatgtctgtcttaccccaaaatattgtgaaagacacaaacgacattatctcattccagtctcagctggaatttcaaatcccattgtctaaatcaaatccaggtgaagatgaggctcttcacatgtagttccttaagctttggcaacatgagtagagttttcttgacggtagatgtgttaactaaagagacaattatctgtcccacatacacctaacatgcaatggcagacaagcaaacaacattatagacatttctgctcaaaaaggatggtggagggaatggaaggcactgtccagtggaagaatcgctggtccatagcaataatgtcaccaaataaggcaaatgttgtaagttccttgtttaggtctcaaaagtgatatcacaccacttttgccatatcttatttgtcaggagttagtgggtcaatctcacattataaggagatggggtccttgagggcatcttagagattgtctaccacacagtttcccagagcctttggctagtttgtgtaggacttccatatgccacaaaggcctgtgtcacacattcttttgtgttatcttctcaatactgcctgtttaaggtgggtaacagttactaccaacaactaggaccccaggaaaagctcaggtttaaatacctgacaaaccaatgattacattagctgccagtggatacctctgtgtgggtgattaagactattattcacctgtaaaatattcatacctctctcacaggaatgtggttagcataaaacaaaataatctatttggaagaaaacaagcataccctttctctaaaaatatttacttttataagtttatgatgctctcaatgtgtagaagacatcgtttcaaatgtagttacataatatgttgatgtatgcggaatgtgctatataagaaggcatgcctttttttcttggaaaattatattgtcataaaaagtcatgtttttgttattaaaatcaaacactatgtatttacaggtctttttttgcaacaattgcccaatcaaattcttatttctgtgaataaatgatatattattattaattatacatttagaagaagcctcggagatcagcaagttgaacctgtcccttttagctgatcagtctgtatatagagttgaaatctgtctgtctgtatagcacaatgtcatgaagtcatagattcctggaatttaatctttgctcttttaattactagaatttgggtacattaattttcctgagtctcagtattcttgtctgtaagacagggctaataatagtacagtgtatattctaacaactcttgtaattgttgaaaagaatttccctagtcaacttatatttgttctctaatctgctccttcacctcatagtctctctagtccttcaagataattatcttggcttctctctaagtcttatctccttagtcatacttattatgatattattttcaactctttcttttcctgtgcactattttcagaaaagcttcggtttgtcattaactcttcagaagttaaaacctatgtcccatggtattttgaaacttagttgagagaatgcatgtcatacttccagagtagctcatatgcagtaaatgatccaaagtatcctgattcatcttttctgtcattttttttcacaccagagttgtgtctctctccaggagatagctttgtaaatattttgctatagtttttttttttttcctcttccccagccacactttacagagtggagatgatactatgcaattctgtctatttaaaatgtatttatattaagttttcttggtatggaaatattgcttatatttatcttgtaatttgttttggctttatagttgtataagagatataagcaaaatgggtctacactttgttttacctgtctaccattaaaaatttcccttggggggaaaaaaaagatgtttgtcttacataactgcagttgttttatatagcctttagtcaacaaaaatatcactcttagtggactaggctagaactgtcttttagcaacttctacttatatatttatgatgatttacttaattgagatataacactttacatattgttctaactttcgtcatctttgttttttctgttccacagataaaaaatacagatatttttgcatattgaggaaataaagtttaaaaatttgacattccttgagccaaaagaaatgtggaaaatatttttcacctttctgttttgcctgattaatgtttaaattctcatcaaaactaaagtaatttttaaaatgccattgttggtaagatctcacagtttggcaatgcccacagttatgacaaacacagaaaactggtatttctgtaaaattgacgctatactattaaaacaatgtgacattatcccctgtccttctttaaccagtagcatacttgtgttttctacttctaactgatcattattttcccatcatatatttaccaaattttacctagagttgtagaaccaaatggttcttactcttcatactgcaaagacatgaatgatgtttggtaaccaaagaaaaatatatgttgcactaaggattagtgttcttgctgttgccactggtctgaccaatgaaaagatggtaatgtgtatattaaagttcttttctctcatatatacaaaaaatattgattctgtcttataacaactggaacttttccagtcattctgtccttcagatatacacactgacaagtgaggacatactgagatgggcgtggatgtcccttatttattgtttgctgtagaaatggaatcacaatctcagaactacagttccagatttcaaaaccttctttttttggcttgatgttataataggaaaatatcttcaatttggtaaagtcaatcttctatccaagaagaataatcttctgcccgtaactacaacttttctaaatactctttcttttttggaaaatgtatggttatgtatatattttactacagagaacacaatgagttttctaacacaattgtgacaatagaaggcaaaagcatgatgctcctgtagctgaaacaggagcattatctttgggaaagctggagttttctctgaagactacagtgtgcctgctgggtcacagtgattccatggtccggggagattgccttattatgcccaacatcttaggaggctgacatttctgtcaagttgccattgtggaaacagcaataggatatgaatactattatttattaactataacaagttgcaatttctgccagtttataaagctacttgagtttgtaaagcttctggttatgtaaaagtgagactgaagtaattaagaccaaatataaattttgtcctatgtcaatacagatcttcaaaaaaataaaatacaaaatatacattgtaagccaactgcaatgtaatcactgtggctttcagggtttgaggtattgaagaattgtaggccatctttgggggaaagtttaccggatatcatttggaaatgaatccccttttgagacggggtttcaccgtgttgcccagtctggttgcgaactcctgagctcaggcaatccgcctgcctcatcctcccaaagtgctgggattacaggcgtgagccaccgcgcctggcctatttttttttttgtattattatttttttagacggagtctcactctattgcccaggctggagtgcaagggtccgatctcggctcactgcaatctccgcctcccgggcccaagggattatcctgccttagcctcccgagtagctgggactacatgcatgcgccaccacccccagctaatttttttagtagagacagagttttgccacgttggccaggctggtctcgaggtcctgacctctggtgatccacccacctcagcctccctaagtgttgggatttccggcgtgagccacagggcccggccttatcaaagatttttcacgaaataaagataatttcatttccttggtttcaacagtgtttcatggaagagtgtattattttcttctcctattatgtgtcttcttttcatatgccctcaatttcccttactcatttatcttttacaaaggcacttcctttctttatttggagctcaaccctcactagcagtacctcgcatatacatgagtttgaatgttcccttacaggaagaggaatgtatttttggcaattctgagcctttttataaagttcagattggatcgatacgttttgcagctttttttgactaaatgaaaactactttaaatgcattattttacctatccgactgactttgtgaattaatggaataatacgagcaatacacttgggctttggagcttagtattgtcagtgctatcgatttgtttagaatatttccatgaatagtttataggatcctagcacactgtggctgaacggaccttttgagacctttcagtctgtaatccagattcttatacttactgagaactgaggctgagatgctacaagacatgcctacattttctcaagtaaagacaaagttaggtttcaacagcaagcatttcttagctatctgctactaggcatagtcttatcatttcacctttactgcttttgtctttaaatgacaaccagttcagatcctcaattcttatagcccaatgtatttatacctagatagaaagatagatagttgtagtccttcttcaatgaggattccatacaattagccttgaggcttaatgacacccttgtaaaatcgttctaattagcaaagatgcattatcacagaagcagttcttacccttcggaaatgtctcgggaaatgtctcacgcagtcattattttgatctggctaaagatgcagtgtagcaagagtggctaggttctactcctagacgctgtcatggccttgttattttcaaagggtgtttgtaagctcctactaccgtgctgcattcatctgtgtgtccctcatgcccagctcagagattaggatagagcaagctcttaaatgttgctggacaattggattttcataagtcacttttaatgattttacatacccaagcatcagctccgattacgctgaaagtgtgatgctcctcttacctagatgacatttaaactcccttcatattgaaaaacagaattatctaaacaaaaaatatggttgaaagagtttatggcaaatagaatttggctgtgaattatgttttccaatccctgctgtatagagcaaattgttagaatcagcatttataattgagtttcaactaaatgctttgttttataatttgctgtgaggtaattagaaaaatgtgcatgaaagcatgacacgtataaatcacaggtatattcatctgaagtattttgtgcagtttatatttatagctcattctgtgaagctaaatccactgtattgaaacagacaattaaaggaaggtaaagggactattttcccagcaattgcaatgtgctaggcatgatgccaggcactgcacaagctctatctccattaatcttctctaatgtaaatattgccaccacttcacaaataaagaaactgaactatgtataaaactgagcttaaggggattaatgaatatattatttgttgttgaacatatgcaggtctaattaaagtaattgcaagttatattaaaagaatttgtggtagagacagaagttgaacccagtgctgactggcactctagttattgttataaaggcaatttgtattattgagttactttgaataatacacattttacatttatttaaataaccatttaatttgtaatgataagtttacagattttttaaaaatagaaacatattatggcatcattgtgtatcaaacaagggctatttataagagctcccttggtgtgcttttattttccttgtctaaatggagccagatgactagaaattgtggaaaagcatagactggttcaataaaatcgaacctggagacaaatccaattctatactctaacacagccatttgtaaagtgtgttccctagtgatattaagaggtgttttgtacacacacactcacatagcaaacattaaaaataaataaatggttacatatgtgcatgacagaattccatgatcaaatatgttgagggattcctgggttgaagaaaataaagcatttgttttaaaattgtgtaaatgctcatatccattgacttgaaaatgtgcctcgtgaagctccaagggagaaatggaatttaaaaaatccccagaccttctcatcacaaaaatctcttttacaagaaacaattgttaaatcttggagtgtaagtagatagcatgatacatcttgggaaatgcttattcatttacttattaacaaaagcgtatgagcacttactgtacgccaatcattttataggtattgggaatgcagaatgattaaaactgacaaagatttctgcccttgtggagctaatattctagcaggggagactaaatataaacaagacaaagaagtgaaatatgtatgactgattctgatgattcttaagaaagaaaaaataaaaacaagcagataaaaggctggacagtgtcaggacaaggagttgaatttttaaacagggagccagggaaggcctcactaagaacgtagtattttagtggaaattgaagttaaggaacaagctctgtggatttttaagggaaaactttccaggcataggaaagttgaaattcaagcgcaaggcaactgtgactggagcggaatgagcaaggggaggagttagatgaggtcagaaaggttaccaggacccagatcgggaaggtccttgaaggttatagtaaggaatttggttttgagtgaagtggggagcccttggagggctttgaacacaggaatgacaaaactcggtattagagctgattttttgagaaaagccaggtgtggttgagagggagggtaaaacaatcaggtagaaggctactgtaaggatctagaggagacacgagggtgacctgaacaaagatttcagccctggtgaactccaatcggattctgaatctatactgagagagagtctgctggatttgttgaaagagcggataccgggtttgagagacagcaatcagagatgagccaggatttcgacttcagtaactgaaaagatgttttgaacttcttagaatgaggaagaccttgagagaaggaggtttggagagggaaagttgaatataaggagctaatttttaggcataataatatcaagatgcattttatgtattcaggtgcagaggtggatttggcagatggaatactaaagtaggcggtaaatatcactcagtttacatagatagatcacatggaaattccaaagttagaatggtctagatttaaatagctaattctcatttacagaaacttcaacgtgaaactacaattctataagctaacttgtgcagccctgcttccagaagaaacaaagaaacagaaaaaatcaaaagggaggaaatatcgcctgccccagtcttaagtgattcccattcgttgcctttcctgggcttgaaggtggagttttgagtaaaacagcagcagtggttgctggatgctttctgatggctctacagttgccctgaaggaatctcaataggagtgttccttaagaatcctgctgatgagcagcactccaccctcaccatcttcaactgaaacagccttagaggaatttttgctggtttatagatcttctgttttgacaaagatagctcgtgacatcactctgccaggctgaaggacttctattctgagactggtgacagcaagccaagaaagccaatactctaagtgaatttaatagactctattctcatgctacttgggttgctatgggaaccttattagaaaatacagggactctagatgatctgctaagttttttttttttttttttaagtaatgtaagtggctttatcttcaggaaaaaaaataagttgtttttctaaaattgtgaacatatagagaaaaatataaaaaacctaaatatgttgcttacacatttgttataaaggacaaatccgtgtaaccagacatatcaaggaaaagaacggtgctgattttttaaaagacagtcacttgcccctttctactcacagtacttccgttatctcaaaaccataaccaaaacaaaaaacaacaaatatcttattatggtctttattttcatgcttgtatttagcattgtatcacccgaacaaaactgacttagactgatttattgcatattatatatacatacataatatacattcatcatgtgaatataatttatacattctactgttcatgagcctttggttgtttctagttttaggatattaggaataattctacctttctacattttagtagccatctttgtataaatgtgctcatttctatttagcatcgttggaccataagatatatgtctcttcaaatttaataggtactgccagacacttttgtgttgtggttttgttgttttgtcctttggttttccaacattgttaaaccgatttacatttcaacttgaattgcgtaagacgttctgttactccacattcttttctgcaccttaaatggtccctagtttgtatattttgccattctattttgtgtgtagtgatatcttatttgtctcccctaaatgagaatttggacaattttcgtctttatttgacatttggataatctgtttgtgaagtatctgttaggtttcttattttctgatagatttcttattttcttattgatttcttagagtaattacttatataacatacaacttgtagctttacaataagtttgtatttctggtagatcaagtaaaccaacattatactttttctacaagtgtgtcctagttattcttggcaatttgtatttctgtataattttaaaatcaactctagttatttttaaaaagaaagaaaaaaatgaacttgatttttatgaagattatgttaaatctatagatgagtttgaaaagtattgataaatatttacatattaaatattctaatcggtctgcttaaaatacatattctttctgtgcatggacattgtctacctcttctgtttgggtcctctttaatgttttccaatacaaatttatagtttgaaaaataagaatgaaaataaaataaaaaatgaaatattctaatctatgcttgtgatacagatttctttatatcttctttcatttgtttgtatcttctttcatttccctcaacatattttatagatttctgtctagaggtctcacacatccttgttagatttaccctttgacatttagtttttttgatgttattgtagatgatatgaatttttaaatttcattttatgctcattatcgttacagagaaattcagttggtttttatatattgagtttatagctagcaaccttgttactcttacttattacacataataattcatctgaagatatttttggattgtctataaaatcatgtcatctgaacattaagatttttttgttctctcttaaatttaaatattttattttttcttaatgtctctctgtctgggtagaccatcttttacaatattaattaaaagtagtcatagcaggtttaattttcttattcccaatctcagaatgaaagcttttaacaatttaccttgaattatgattttgcttaaggcttagaagctatctgctattgcagtaagaaagtttcccttctatttctagttatcaaaaaaattttaaaaattataaatatatattgttttactcaatctatttgtatcatatgatttatcctttagtttgttattgtaatagtaaaattgattagttttcaagtgttaaaccaattatgcattcctgtaataaattcaacttggttgggatatattataccttttaaatattgctagatataagagttctatttttgaaagattttttaaattcacgtttataattgtaatttgggccttattttaccatgaggaaatagagatgttgagtactagtagacatttttaggcctaaagatgaaaagtcttcagtgtagccaaaaaaaaaggcaagcgagaaatgaaagaggcaagaggaaacaacagacagggcacaagagattcaaagagaaaacacataaaaggatgttagaaataggccaagcatggtggctcacgcctgtaatcccaacactttgggagaccaaggtgggaggatcgcttgaagcccaggagttcaagaccagcctgagaaatatagcaagacactatctctacaaaaaattttaaaaattagccatgagtggtggcacaggcctgtggtactagatactcaggaggctgaggtggaaagattgcttgaacctaggagattgaggctgcagtgacctgtgatcataccactgcatttcagcttggatgatagagtgataacctgtctcaataaataaataaataaataaataaataaataaataaataaaagttaaaaataaatttaaaaaataaatcttcataatcaatggacatatgcacatacataccaggcaaacaataaccagagtaatgtgtattattaatatcacataatataaaattaaggaaagtttattagaaataagtttctctctagttaataaaatgtttacctaactaggaagataaaaaattgtgaaggtatatgtacctcataacaccacctcaaaatatataaaggtaaaaatatgtgtgtgtatattcctgtaactatgaaattgatagaataaaaaacaaacttaaatatttataacataatgggatatcttaggcacctttcatagtgattgatagatcaaataaataatcaaaaatttaaaagattatgtatgatatgaagtgtataattaagcttgatgtgatggtcacataatgaatgttatatctgaagaacagatactgtttccaggaacatatcatttatacaaataacaacattctagtgcataacacagcctccacaaatttcaaagagttgatattttgcacaaaatactaaccacagtggaataaagttaaaaattaataacaaaaaggaagaccagttatgccttttataatcagggatattaacatatttatagttaattcttagaactagaagtaatgataatggaaattaggatatatttagaattaatagaagtgggccaggcgcggtggctcacgcctgtaatcccagcactttgggaagctaaggcgggcagatcacgaggtcaggagatcgagaccaccctggccaacatggtgaaaccccgtctctactaaaactacaaaaatttgctgggtgtgttggcgtgtgcctgtaatcccagttactctcgaggctgaggcaagagaatcatttgaaccagggagtaggaggttgcagtgaactaagatcgtgccactgcactccagcctggcaacagagcgagactttgtcaaaaaaaaaagaataaatagaggtgaaaatacaaatacttcatattgaaatgtctaggatgaagctaatgccatgtttacaggtaaatttatgaacttttcttatattagaaaagacaaatggctcagtgtaataaaccaaaaattccaccaaaaaagttagaaaaaatgaatcatagtaaaccaaaaagacagaagtaactgataaagaatagaaggaaaaaatgaaataaaaattatcagataaagagaggatcagatgagacaaaagttggttattaaaatgttaccctataacaaaacaaaacaaacatcaagctcagttgattttggagatgagttctataaaacgtaccagcaacacaatttcaagttatacaatctctttcagagaattgcaaagaggaaacatcccaaaatttattttaaatgcatggcataaccttaaagacaaaatctgtcaaaaacagtacaagtgaggaaagagcaaattgaacccagcaaagtataaggagataatatcacttgatcattattcctgtaatgtaatatttcttccattttagcaaatgtactaggtgtaaatcaccacattaaataataaaggagaaaaaaatgatcattttgatagtaacaaaaaataattaaataagcctagcatatattttttttagatgaggaaaaactgttaggcaaagttttacacaattccttttaaatcagtggggaccaatagttttaaaagggtaagatttaagctgctctacaaatctacatataaaccaatttgtgtcaacatctcccattttctttgtcatccgtaataccaattttggttctcaggttaatatgtcatttttcctgtttgagatttttctcctgtacttagagtcctttaacttctccactgcctctcacatctttttgtataaatttgtatttttcctattaagactcaattcatctattaccttcactgagaaatattcccgagaacccttaccctgaattggcacaactatcaggctccataagttttgcctctacaataattttttttttaactttaagttctagggtgaatgtgcagaatgtgcaggtttgttaaataggtacacatgtgccatggtggtttgctgcacccatcaacccgtcatctaggttttaagccctgcatgcattaggtgtttgtgctaatgctctccctccccttgcccccactgcccgacaggccctggtgtgtgatgttcccctctctgtgtccatgcgttctttgttcaactcccacttatgagtcagaacatgcagtgtttggttttctgttcttgtgttactttgctgagaatgatggtgtctagcttcatccgtgtgcctgcaaaggacatgaactcattcttttttatggctgcatagtattccacggtgtatatgtgccacattttctttatccagtctatcattgatgggactagttttatgattcatttctatcatggcaatttctatatgatattgctgttaatatgtagatgctattcccactgagctgtgaactactcaaggcagggggtgtgtcactcatttcagacctccagcccttagcactgttccccacatcctgagggcatccaatacacctttgtcaaatgggttgaagagttgagcttagaaatttacattctttgttcctgggaaggctaatcatagagaaggcataaacatgaaacattaaacaagagagtttaatcatattttaagattatctgagaaaaaaatgaaagacaatccagcacaataacattctttttttttttttttttgagacagagtctcgtctcgctctgtcacccaggctggagtgcagtggcacgatctcggctcactgcaagctctgcctcccaggttcacgccattctcctgcctcagcctcccgagcagctgggactgcaggcacctgcctccatgcccagctaattttttgtaattttaatagagacggtgtttcaccgtgttagccaggatggtctcgatctcctcacctcgtgatccgcccgccttggcctcccaaaagtgctgggattacagacgtgagccaccgcgccctaccaataacattttatttctcattttaatgttgtaaaataaagtgagtgacagctggtttgagtcaccagtctgctgtttactggctggcctaatgtcatttccttgttggtaaattatagataattattttactatagcattaggttgttgataggatcgaatgaaatactgcagctaatgtactcaatgcagtggctgagacatggaagtgcctctgtggtctatgagtattatctttccaatcttgagaggtagtagaaggctacaaagtgttggcgtttgagtggtgtttaagaaatggagacaatttgaagagaaagtgatttgggggtttgcaagtacagtttacatgatgaaaggtaagaaaagaatgaggctgacatttattgagcctcttcaacatgtgagttgtttgaccaggcatcttcctgacatcctaccagttaatgctcacaaccagcacctgatgaggtcctaccacaccatttactcatgaaaaactgctctctggaagttatgaagcacatgctgaagatcacacttggtggaaccaggctccaagcctgtctgattttatagctactgaacttcttctggagatggctagaaaaggaggaatcaaggatctgtagaatctttcctgtgcctggcaaagaaggatgaggctgactgtgaatgaatttgtggatatagataaatagctattttccatgaaatacctgtttattgttgtaggacatctaaaagcagattttaatgagaagaatgatgttttgattttctacatgaaaataaatgtgaacattgatatatgtaaaatatgtaagtgaaaacctttgctttttgaaaaattaaagtcagtacctcaaatgtggcttataagtcagcaaaacaacctgaaactagatttaatatcatgtttattcaacaaattatatggttagtaatcagtatgaaaggttgtttcttcccagtggactgtagcagaaactaacctcattacatttgagaaaccatcattgctagggactagttgaaatgtctgtctcagaatggcaaatggaattgcattttaaagaaacttagagtctttattgttttcatcactaaaccccatactcatgattagcaggagtcatttgtcagctgaaatcatactggttcttccattttagtttgatccatttccatccatctgctcatgagagaagaaattcggtttggtgaaggatgtctggaaaatgcgaagaccaccaacttgggaaacttttatcatcacgatacactgtgtatgtctctgaacaacaacatggtttgaatgaagcaaaatagagacttaaaatgtaactaaatgtacaattgtatgaatgtgtaagtgctatggaagaagaagcctttagaagttctcaatatttactgcagaatttcaaaatagtcttggattaaacaccttttgagaaaaaaatagacgttcctaaaccataatctaatgcttgagagaacagaataattttcagtacaagtaagtttaaatgctaaatgagatgagatggttaaatgtccagatgaaaggtaaaatacattgttccatcactgaattcacagtaacatgcaaaagatccatcttgaatataacctgcccagtccctgaaacaaacccaaggcttctttttttttctgatcttgatttcttgaatgcatagtgcttttaaagaactaacatgtcttttttgttttgttttgttttgcgatgcagtctctttctgtcacccaggctgaagtgcagtggtgggattttggctcactgcaacctctgcctcccgggttcaagtgattctcctgcctcagcctcccgagtagctgggattatagatgtgcgccacaatgcccagctaattgttgtattttttagtagagacagggtttcaccatgttggccagactggtctcgaactccagacctcaggtgatccacccgcctcagcctcccaaagtgccgggattacaggcataagccactgcgccctgctagaactagcatgtcttaatgtgttaggtaataatagaaatgtttcattctctaattaaatgatgaggtgattaatagtaggttaaagatactgtaattatatattgagtaggatactattaatatatgttcacttagcacttactataaggaggaagacataatgtagccttacagcccagcaactagggacccttccaacttcaggtcctcaatcttgtgcagcagacctgcagagtctccttaaagggaggccagatgtgccagagagtcagtgcccctagagcaaccctcaaccaatgagagatagcagttgataggtaagttccacagcctcttgctccacattgggacaaccctgagtctgtccacactggggctgagccctggttgcctacagtggtcagccacttattaatccatcctttattggtctctcccttttttaactcccaaaccccctcacagtgttccttgggatcaattcctaaatccttctctcagagtccaactaaaacgtggaggcaaatatgtaccaaatagagctcatgttctcccttcaagaccacccttcaggtgtcaggagcctcacctggaggctccctacccagatggtcttaaggtgctcacagggccagctcagatcaccctttccatgggttctgactacacaaaagtagatggtgtgccacagtccatacccctaggcccaaaatttggaatgaccttggacatccagattgattgcatacacatttgcatgatgctcttgtcaagaggaaatcagagtgagaagggaaagggagcaggttctgggcctgggcctccatttgcattcttgccttggaattctgagacattaggtgtggggctgaatagaaggccaggagttttaccttttttttttttttttttttttttgagacagagtctcgctctgtctcccaggctggagtgcagttgtgcgatcttggctcactgcagcctctgcctctcgggttcacgccatttttctgcctcagcctccctagtagttgggactgcaggcaccccggctaatttttttgtatttttagtagagacaaagtttcaccatgttagccagagggtctcaatctcctgacctcgtgatctgcctgcctcggcctcccaaagtgctgggattacaggcttgagccaccgcatctggccaggagtttttatttcattggttacacgcagtgaattattggcaggtgaccaaattgttttggtctttaacgacttcatgtgtataatgagggatgtatctaaatttattcatagggtccctacaagaccataggttctcattgtcaaagtcatagatagccattcttctgcacataagggacactaaaaagtacccccttattttctggctgggatctctgaatgctcacactgtatgatttggtggggctctcatgccatctgttctaggcctctatttactcttggtttaaagaacctagagtccaaaggtgcatgaataatgcaagtcatattttagataaaataatacagataacaactgtacttaacagtatgaacaaaatcatgcaaacaaaaccaaaattgatatctgaccagggagaaaggacttaggaaatatatcagtacataaatagtgaatttttatttggatgtgttgcaggaatgtgcgtagtatttttttctctgtgttttaactttttcctacctgtgcatttcttagaatcagtagctttgtcagcatgcactcagagaaaccatggaagcatatttagtaataaaattgttattcttatagacaaatataatcgtttaggaactagcatggcccttttattctcaaaactagcctcagtcattgacgatgattgctatttaaaggtgtagagggaaatatttggggaattgtctgcgtatttcaaagtacccttaaaaatttaaatcagacaaactggataaattagacatcctcaagtactaataggcaggtctgctctaagaatagtagaaggtagaagaaattaatggttacgagaggggtagaggaaattaaagttaataactaaagatattgcactagtttgtttttgcattgctataaagaaacacctgagacttcgtaatttataaagaaaagaggtttaattagctcaccgttctgcaggctgaacaggaaatgtagtgacatctgcttctggggaggccccaagaagcttctaattatggcagaaggcaaaggggcagcaggcatctcatatgatgggagcaggagcaagagagagtggtgtcacacttttaaaagagatctcatgagaagtcacacagtatagcgaggacatcactgagggaatggtgctaaacaattcatgagggatcccctgccatggtccaatcacctcccaccaagccccaccttcaaaattggggattacatttcaacatgagatttgggtggggacacgcatccaatctggattgcatatcctcatcaaaatgtcaatacttttattttgatagtgttactatcattaactatgtacagtactttattgttaacaatttttttctccagcataatactgtttagtatgacattactgtaaattattataaatgtcttaaagattattaatttcagaatgtatgatgtattgcctttaaaaatgaacatggactttttaaactaatataggtataggaagaaataaaatctcattccttgacaaatactaataaaacttattattgagaataaaataaacagtacttatattatgtcagatattctgctaagtcttttgcatgcgttatttcattttttaaaatcacagtggccttatagggttggtataatgatccccattttacaaatgaagaaaatgagacccagacacactatacaatttccccagattcagtcagaaaataaatggtagagctgaaaatgtactcacatcctaaaggctaaagcctttattatgataaaactctgtgagatgacacacattttgatgactgcattagtttaaaggaaatttttttcatggattttgccttcgttttgctttgttttgctagtgaaattggtcctgctaagcagtataacacaaaatgagacctcagatctaaaattcagagagctctaaaatcaccaaactaatctaataaaagaaaatacagattttaccgaaatttaataggagttagttaatataaatgtttgaaataataaacatccccagaactatctaacagcatgtgttataatgtccgtttgaactgattttaaatgaatagaatgtttttcattccctcctgtactgagagcgcttgcctttgagtgttttaatatgtcagggatcatttatattctcaaaaatatattacatttatttggtttcattctttatctttcaaccgtgttttaaatatttacaatttcagcaaatttgaattttttttgtctttaaaatgcctctccaaaggttttgaaatctctatgtgtttgtgtgtgtgtatgtatggcttttattggccactgatccaagtcgctccaaccttagagaggtggaaaaatggtgagaatatggattatgaagggacaaaaggatggaagccaaaaaaaatacaattcataaaaggtcctggaatctttcctacacaaatgcccagaggcctcctcattctcaggtactgctctctgcaggatgaacctttcacctccactcccatccagctctaggagtgatcctccagaagaataatgggacttttagtgattccctgtagccaatagccaagcggcagcagaatggtacatacagaacaggtgaagatttcttaagcaccagcagtgattagaacacagtgggataaggtcaaacagagcagcagatggctaaaattatatgtgaaagtcgttttataattgtgaagaacttggtggtggtgcacaaatccacattctgtgttattcaggtacctaacatcaatcctcctggtttggaagacttcagatttcacagtttagtaatcaccatgctttagcaatggtacttgcttttatttagcggcactgtaataaagattactcttaatttaaagtataccccttatatagtagctttttcgtttcattttaggttttaatatatttgttactgtagctaaatacataaatggataggtaaatatatagctagatggatataaccaaccgaaagatacatgagaccatttttagtaacattattctattattgcatatatttcatatactatgtacatcatggacaaccttgatgatgagactcaggcaatctgattaaatattgggtttattcacagtttgtaaatattgggtttattcaaagtttgtgaactcaggaggacacagactccaaaaggaaagggtcagtgctccaaagagggaatgtttgaagatcatttaagcaggaaagttctggggaagattaaaaagattacattatttttccatagagggttagtgaatagttacaacaatttgcttagttatatgcagcatttctttttttttgaaaggcatatttaacattctatattaaagaaagacgtaatagtcaaggggtcttttgtctcagtcaaggggtctttttttatgtcagggccacgtggtcttagccataaaaaaggaaattcggaaggaagttaatctatttttgaaaggtcagtaattaaaagttcaagctgtgtgactcagtttccaaagtcaacaatcttcagggcctaataacttttagaaactccaaatagacacactatccatttgctttcacatcatcaattatgtatttaaaaagaactttgtttctgtatacattattatatgtattatatatgtgtatatacatatctgtatacacatgtatagttgacccttgaacaacatgggtttgaactgtctcggtccatttacatgcagttttttacaataaatgtattggaaaattttttggagatctttgagtttttgggtttgaactgcattgatccatttatatgcaattttttataatatattggaaaatattttttggagatctatgagtctttaaaaattcacaggtgaactgtgtagcctagaaatatcaaaaaattaaggaaaagttaggcatgtcatgaatacataaaatctgtgtagatactagcctatttcatcattaactaccataaaatatgcacaaatttactataaaaagttaaaagttgttaaaacttacacaaacacagaccataggtggcatcatttgcagtcaagagacacataaacaaatgtaaagatgtagtattatgtcttcactgcataccattcactatagcacatactgtaaaactgtaataagtttgtagttgcttcttgttgctatcgtggtgagcccaaatgttgagcgtgtttgcttaaaatacgtgtgatactaatcatctccatgtaagcattttgcctctccagtaaattgtatatccagtaaaaagtgatctctctctcttgctgttcttatatatttttcattgtgtttagtgcagtaccttaaaccttgcataacaccatgggacccatacaaagttctgctagtgatgctggaagtgctcccaagaagcagagaaaagtcctgacattataagaaaaagttaaattgcttgatatataccgtggattgaggcctgcagctgcgggtgcctgccatttcagacacaattcatcttgtaaacagatgacataaacttatggtattgataaataaagcacagtacttcaaatgtattttctcttccttatgacttccttaagaacatttgcttttctctagcttatcttattgtaataatacaatatctgatacatataccaaatatgtgttaatctactatttatgttatcttaaggcttctggtcaacattaggctattagtaattaaatttgatgggagttaaaagttatacctgaattttcaactgtacaggggtcagattccctataacttccacattgtccaaggctcgactgtacattacatatatatatatatgttataaagaccagcaagatttcagacacaagcagtgaagtctggacttacagatgtgttgactctggttactgtacatgtcttgtcatccctttggcattcaatcgtgtcactttacattatcagcttgtattttaacatcttctttttttcaacaaatatgcagaatagattttctaaaagttcagacatggtacaagacaagcttgtccaacccatgtcccacaggccacatgtggcccaggacagctttgaatgcagcccaacacaaattcataaactttcttaaaacatcatgagtctttttgtgattttttttagctcaacagctattgttagttttagtgtattttatgtgtattgcaagacaactctttttcttcaaatgtggcccagggaagccaaaagactggacacccctggtgtaagagatggtggcatggtaatcacagtgcctctttaatgtgtcatggatactcattaatcattcaacaacagaaaatggttggtctcctttgccctccttaaaatgagacatggaggatgagcagcatttaaaccggaagaaagggagcttggtggggaagatatttcaagcaaaatgcatcaaagtgaagttctagaggtagctaagtatggtttatgcacatctttgttgaaacagtattcctcaatgttttttatatcatgggaaacagaaactatggtttgtgagatttgaaggaatacatagaagcatatcttaggcatatgaatgggatatgcctatatcaaagaacagtaatgttctttgctagacctctgtgttagagaatcatatacatgaacaaaaatattaggaaatcaaaaaaagtagatggggaaatgatttcagagggtttcaatggtgataatgatgtcaacaaaaatagcatcgactatttttccctgaggagcccaaagtatttctgatacatacttccagtcatagatggaactgattgagcacaagcttaattctaacagaaacaaaatgtgagaacttgaactttaaaagaacattttctatcctgtagaaagcatgatctaaatttatagtatgcctgacaagtgtggatttttcacaattccctgaaatacagaaaatgaatttaattaattgtgctccaaggctgagttcatactttggcttgaattcattagcaagtagcattttaaaaaggaagtttggttgtgggtgtctgtccaatttggaaatatttacccatggtctttatatttaaaatgtgtttttgattttcaaattctgcagattatttatatccatatgcctgttcagtttggtgtattcataacatggttcacactggccttgtattttctcagttcactgtatttatcagtttctctccgattgtcttaatccatccagtcctccattccatttcctaggcattttctccaaagccttaatttctttgtcttcttcttctgtgttgacagtgattattgaaagctttttcttcattccaccaggttacctgttcagaaattgggcttctaaaataaggcatttagcaccaaaatctctattatttgaatggttattccatgttttcactgttttgttgtttcattgttttttgtttattttgttacatgtttttactgaattattatttttatgaagttcttcgatagtgcaaaaatcttggggaaagtgtgcttccttttctttaaatacactgtctttcagaattggcttttactttccttgctttctgaacctttattttccttcattcctgctaacccccgacctcccatttctttcttcctttctctctagaatttaaatagttatcaagttgcttcttttcatttgctcatatttatttaaagggcagctttgtctgaaacttctactcatctggatgcactgagggattgctctctttgaccctatccaagatattaacaatgtttctgtcttttccctgggcttcatgtggatgctaattttgcttctaaccacattcctgtatcctgagggcaatgggataggttagaggctagcttagctgtggccatgtcatatgtcaatctagcaagactagattatctttaccaaaatcttatcaaaaatatcaaacatggccttctgcacccagctacgtgctatcctgctcatacagcttcacccaatttctaaaactcagcatactgctctagaactttctgactccactgagctcccatagcagtatgttggggcttctcttcttaaaactattccctcaagtagtctcctcagctctaaaaattgagtgggaaaaccagcaagaatcttcagggctttattcccttctgctcctcaatattaaccctgtggagaagacatggggtttgaggcttcacacgtcgtatcataatttatactacttttcatgacagcaatgttaaaataccttgtggcataagatcacactctagtccttttttagttgctgctgttgaactttgggcttttattaaaacattaatttctataggtgttggggaataagatttgtaacctggctttacttaatcatctttatccaaaaaatattttaaaacagcaacagtttgacataaatgtagcctcagaattttcaatattagaagaataaataagttataaattttgcctatttctatattgccagatagaattttaagaccacaagacatcatgaaatttaaattaaaacatgtccagtaggaaaaaaggttttgtcacttaggtaacatgactaacatcctaatatgctttctcgcatttttttaacataaggcaatccattgagcaaatcacaccaacatttttttttcatcattcttaaatgtctctcttctagaaagggtgaagcatataaaatcaccttgttattaaaggagttaagaaagaagtctgcagaaatcagtttggaggaatattgaatctagtgttttgttttttcatagaaactttagaaggcatgatggtgattatacacataaggaaataaagaatggctgtattaggtcttaattagtgattataacagtggcaaaataacagaagttgaatgggtccttacatctcacttcagagaaaagtgtaaactgcagtcaatacaaactgatttgggttagcagtcctattattctcagttgcccagagaatgaagaaaatgttctttatcccatcgctaagagcagctacagtgaggcatcctctcttggggcgctgtctacccttcatgcctctagagattcttggactctttgctgtcttcactgagttttagttcactgggggataaattcttataatttctttccaggtttaaaataatacctgcctatatttatttgacattatacagaaaaattttggaagatcttcttatgtaaaatttatattctgtggagttgaagctatattatgattttataattttctggaatatatcattttaccccacttttaacagtttgcgaatcatggattctattgtagtctcctcctttctcaagtcagttcacatcttgacaaattttttattaatcaggattatacaatgttgatccagtctgtctggaggctattaagaagcattaatggaataaaagggatattaatttatcatcaattatttaaatggactgtttcttaaaccagtctgtgttttaatataacttgggcctatggaaccttcgtagttgctattaaataagaaatatatgtgatgtatgttatacaacatataaggtatatattatctatacacttttcatttatttcaatacagaaggttttccatttaattccacaggtattttttaagcactaactgtatgcataggtactgtatataaatacaatgtaagtagaagctgcagcccatgttttgaggatgtgaagtctacatgtgtagagcaaatgtgtgaaaattatgaaaccatttaaatatatattgatcaaagcatgtaggcaatgttttgcctgtcttgaaagcttagaaccttagcctgacttatgaaacttactagatatttacccgtgggataaaccatcattcctccttgagcctgattaagctctctttatgaagacattatggataaagtgtcaaaatggtgcctggtttggagtagcttctcaatagccattacttttctgcaagcctgatgaagcatctcacatcacaagagactttcagatgtctgtgtattgtggtggaaaaccaactcccattcctttgcaaggccagaagcaaaagctgccatgaggaggtggtcttaacatggcctggcacatgtaagctgttaactcactaggaaggaacaagtttgcaactggtgcaggagaatgtctcagtgatgagcaagacttctgcagtgagtccacaagtatgtctttatgcctggaattcattatcaaggaattcagaaatgttttctgagaagaaatccacctcggtaccctgcatatttcagtacaccttgacctgagcagaagatacactgagacctgccaagttctgagcatgaaaagctttaattcattgtgttaaatggcaaaaccaagcaactggtgatttatggctgcaaattatcatgttgttcattagtggtaattactactcaaccctgaaataaaacggcaatcagtatgctaaaatgagaacacccacgctaactccttgctgttcacctgcaatcctctctgtctgtctcactttccaagggaagagaaaaaagactgagggaatccaggtgcatgtactatggacagagatgagcttctggccatactaaactgcttcagtggctcctgtcaggcaaaggagcttagctccatccctagatgctctctgttcacaatgagataagagatttgtgtttggacatactctgggaatgctcagattgctttcagcgactggagctgtggcagtcaggagggagaggaagccaatggaggtagtgtagtgagtagacaccacgccctcagcgactggagctgtggcagtcaggagggagaggcagccaatggaggtagtgtggtgagtagacaccacgccccagatgactgtagctcccgtggaccccattagcactgtcctccagtagtctcttcaggctatatgcctggctgaccatcaggaaactgaggccatgccttgcgtagaaagacttaatttcacttttgaacagatggccagaaaccatgcaatttcacctgctgtatctgttaatgtcacactaaacagctatgaagtaaaaactcccatgcaaacaggttttcattttatttctgtcacaattattacctcctagagatgaccttcaatgcagagaaatggatttttgactttaacataatgaatcttatgagcagttcacacaggcattctgaagaacaatacaggttgaacatccctaatctgaaaattcaaactccaaaatgctccaaaatctaagattcttgatcattgacatgatgctacaactggaaacttttacacccgacctcatgtgacaggttgcagtcaaaacacaagcacacctctcatagtttattcagtgaccccaaggggaaaaaaaaagaccctccaagtaccattcacttgtgataggtattttctgtgcacacctagatactcccacacaagtatgcccacaatggtaataaaatgacacatgtgcagaccagaagcaccagcagtaggttcctaatgatgttccacatgaggccaagacctacgttcattactcactgaagtttttggcttatgctatgctctgtgatatcaaggatgtgatgatatttgttgaaaatgtcaaaaaagcctgtagatacctctatgagtaacagtgataagaacaagaagaaggatttatgttaatttagaacacagaaagtcaagctgttggagaaactgaacagcagtgtaagtgtgaaccatcttacagaagtgtatgatggtagaatggctaccatatatgacttgaagaaacagaaggataaactgttgaaattctatgctgaaagtgataaacagaagttaatgaaaaatagaaaaacactctaaagcgaaaactgaaggtcttgattgcatattgaaagagtggatccagtagtgtcatggtaaacatatgacaatcatattctggccatgaaacaagaaaataccaattacaatgagctgaaaaattatagagaactgtgaagattcaacacgctggctgcagaaaatttttaaaagacaaatttgtaaagacttgtgataaatcatctgcttatcatgaagcagaagagaaattcattgacaagtttgccaatgtcatcactgctgaaagtctgacaccagaataagtctataatgctgatgtaacataacgattttggtgttattgccccagaaagaaactgactacagctaatgaacagctactagaggaattaagaatgccaaggacagaataactgcaccaggatgtgctaatgcagcaggcacgcttaagtgtaaacttgctgtgttaggcataagcttgagtcctcaatgttttcaaaaggctaagttcttacttgtctattattatgctagcaggaaggcatgaatcaccagagacatcttctctatctggttttacaaacatttgtaccagtggcttatgctcactgcaaagaagctgaactggatgaggactagaagatttttttattccttaacaaccgttctgttcatcctccagctgaaattctaaaaaataatgtttatgtcatgtactttcccccaaatatgacttcattaatttggccatgtgaccagggtatccttagatcaatgatgagtaaatataaaaacactttattgagcagaatgctaacagcagtgaacagtagtctgggtatggaagggtttcaaaaggagtttagcataaagaatgctgtatatgctgttgccaacacttggaacatagtaactgaagacacagttgtgcgtgcatggcacaacatctggcctatggctatgttcagtgactatgtttcaacccttcttgcacagatggactgactttaaaatattgattaatggcagcagaattaaatccctttacaaaaatcattgtcattctttaaatagggtagagggtttaccttctgaattttccatttagcatgggtcagaggtaaatatatatgtatgcacgatctttgcagtgagagaaatcaaagaatattaagatctctttatgcctgctaattttgagttgtgaatttttgagtacgtctaaagaatgggatatggttaagtggtttataagcattttttttcagtccttgattcatcttttcattatctttaagggcagatatttttaatttaaaaaaatctaaaattttaattttttcattcatgggttgtgcctttggcattatatctaaaagctcaacacgaaaccccaggtaacatagattctttctggaaagttacaagctattaatttaattcttttaataaatgtagtcctattcagattatctacttctggtttttgtagattatgtcttttaaggcattgatcaattttatataatttataaaatttgtgggcatacacttgttcataatatttattatattttaatattgatgagatcagtagcaatgatccttctttcattctttatatagtaatttttgtcttctttcatttttttcttagttaaactggcttttagaggtttaacaattctatttatcttttcaaagaatcagtttttcttttcattagttttctttattgatttcctgttttcaatttcattgatattgctctagtttttattatttctcttcttctgattactgtagatattgatcttccttttctagtttttaaggtagaaacttagattaatatttagatctttcttcttttctaatatattcattaaatattataaatttccctctaagaactgcttttgttgcattgcacaaattttgatgagttgtattttcatttttctttaattcatttttatttcaaatttcttttgcctcatctcctttgattcatgtgtttcttatttatattttaatcccataatgatctgagagaatactttgtatgatttatataattttcatgtgttaagatatgttttgtgacccagaatttggtgaatattttatgtgaaattgagaagaatgtgtattctgctatggttagattaagtcttctataaatgtcaattagatccagttggttgacagtgctattcagtcaactacatccttactgatagcctgcttgctggatagaagggttcaagtctttaactaaaatagtgaattaatctatttccccttgtagttcttctagttttagccttacatattttcatgctgggtttacaggcatcatacattttaaaaattgttatgttttctggaaagttgactcctttatcattatataatgctcctttttatccctgatatttttttcttgcactgacgtcttctgtcttctttacctgaaattaatatagtcacaccatattattttggataagtgttagcatggtatatcttactccaccatttatggcacccacgccattatatttaaagtgagtttcctaaagacaatatatactttcatcttgtttttaaaaatatacttcgacaattgcttttaattggtttaggctatttatatttatagtgatttttgagatttctggattaatacctatcatatttgtaaatgttttttagtaattgatgacctgggtttttgtttctttttctttgccttccattttgttttttcatttttggatctaattaagtattttatatgatggtattttatcttctctgttagcatatcaattatgttttctagatatattttgttagtgattccctacagtgtgctgtacatttacaactaatctatgcctactttcaaataatactgctcttgactagtatagataacttataaaaagtacttccggccgggtgcggtggctcacacctgtaatcccagcactttgggaggccgaggcaggtggatctcaaagtcaggagatcgagaccatcctggctaacacggtgaaaccccgtctctactaaaaatacaaaataattagccgggcgtggtgcaggcacctgtagtcccagctactctggaggctgaggcaggagaatggcttgaacctgggaggcagagcttgcagtgagctgggatcatgccactgcactccagcctgggtgacagagcgagactcaatatttttaaaaaaagaaaaaaagtacttccaattacttattttcatcccttataacattgctgtcattcatttcacttattcataaactataaccacccagttatctgttagttcaaataaaaataagaaaaataaacattttattttacctttatttatttttttctgtacctctctccctttccctaagtaggtctgagtttctgacatataattttccttctttctgaagaaggcttaacattttttgcaaggtatgtgtactggtgacaaatttccttaatgtttgcttatctgagaaggaatttctcctttacttttgtagattaaatttcactggctacagaattctaaattggtgatggtgggttttgtttttccattaacatttgaaatattgactgccttctcttgttttcatagtttctgtgtggaagtctgtaatacttatacttggttctctataggtgaggtgttttcccttcccaccattgcacattcccagtctcttttcaggattttgttttgattttgtgcagatttaacatgatgcataatgtagagtattttccatggttggtattctccagcttcctggatctgtggttttgccttcatcattaattttggaaggttgtcagctattattacttcaaaaccttttctatatggttttctcttgattttccttctcgtcttcctataatgtgtgttatatctttttaaaattgtctcctagtttttcaatgttctgttccactgtgtgtttattatttttctctttgcttttcagtttttagtgttgctattgatacatctttaagcatactgagtccttccttgagaatgttaaatccactgatgatcatcaaaggcattttttacttccatttcagttttttttttctagtacttcctttggattatttcttagaatttttatctctctgcctacattacccatctgttattgcatgttgtgtactttttcattagatcctttggcctaacaatcagttaaattcattttctgatcatttaaaaatctctgctgtatctgagtttgattttgattctccctttgtctcttcagatttaatttttttttctttttctttttagcataccttgtagttttcttgtgaaaagctagacatgacatattaggtaaaagggattgacataagtaagcctttagtgtgagtttttaagtaagtttttttcctgtagctagcagtcagtttttgtttaatgttaactgtagttacaggtgtcagaggctaaaatttccttctgatgcccttgtttttgtcttccctgttgtccttggacttccctagagacttctttctaaataaattctgaaacatgtggttttttgtttctattctcctgttattgtgtaggatccctgtttatgtgtggtaaggtgtgcaggaaagaaagtgttttattattctatgatgagagctcaatcctctagtgggcttgagccccagaggtgggtccttcacaagtgatttttagctttttttttttttccccacacccctccccttacatgagacaagctagagaggtttcaaattaggtatttccctccaatgttgaatgttagaggaagctgtaattgggtatttctcatggtggttaggttctggtacaatagttttctctggggaaaggcctttgttaaggagaacagaacattctgagtatattttaaatgaaaactttttcttttcccctgccagatgcattaggggattttcctcatcttcaccatgataacctctagaggtttatggaaggaaaacttatgaaatcatggggatccttctaaggctggtcctgcagaagtttttatatttcaagcttgtccacacccagtgtccaactgttagtcaagtgatgttgaagtgttttaacttgtttctgactccagcaatggcttctgctccctgtaatctataactgtatttatctttctctgcagtttttaaggtagcagtttgccctgtgacttccattttccaaaggctctaagaagacttgttcattttgtttcactttgttctttttgggaggataacagcaataactgctgagctctttacatgccaaaaaagaaactaggaggtctatgacctgtttttgataatcacatatgactttgtagaaatcaggaacaagctctttgacaataattaaggaaatgtcagtcagataatttcatatttgaaatacagtaaattttttaaaaacaaaatgtgtatctttttaaaataaacaatattcctggcacacagtgatgctatatttgcatattcccttaagaatttaaatattgtgtaatttttctatttgctgtggcaataatacaattgagtgaattcttttgcacttcaaagtaaaaaaaaaattagacacaaaatgttcctagtgagattttggctaatctgatagacccatatgtaaatgtgctgtacaaaagtctgaatattttaaaactgttaatgcatgaagtccattttaggttggttccacaacctaaatgatactcactaaacctaaaaaattcagatgataatttttattataaacattggggaatatatacatgcattttcagtttctctcatatttcaatttctgtgatcttataaattcaacaaacgtttatttttctgaaataaagacatttatactcaataaaatactgtaatattacagatctcctgaataaggctctttctagtgctagatctcagtagccttttttatttgttcagagaatggaggaaggcaaaaaaatccaaaaaatatatcatgttctatttgtataaggctttacattggataaaagaacactattgatatctgaatagaactgttatgacttatttgttgttcttgtcattgttttacttctttaaggttggggcaatgcctgagcacactggtttacacctgtgatttcagcactttgggaggccaagttaggaggattgcttgagcccagaagttcaagaccagcctggacaacacagcaaggccccatctctacaaaaataaaataaattagcttggcatgatgtcacatgcctatggtaccagctactgaaaaggctgaggtgggagtaatgcttgagcctgggaggtcaaggttgtagtgagccatactttcattactgtacttcagcccgggtgacagagcaagaccttgtctcaaaaagtaaaaaaggtgggggaacaaaaataaaaatttctgtacagcaatgtagcaaagttccagtataccttatataatgttagtcacctttgtgtgagattctcctctattcagagatgtgagtaaatagatgcatattaagtacaattgtacagtataaagatcccagcaattacattttttttttttttgagacagagccttgcttggtcgctcaggctggagtgcagtggtgcaatctcagctccgcctcccaggttcaagcgattctcctgcttcagcctccccagtacctaggtctataggcgcgtgccaccacgcccagctaatttttgtatttttagtagagatggagtttcaccatgttggccaggctggtcacaaactcctgacctcaagtgacccacctgcctcagcctcccaaagtgctgggattacaggcgtaagccacttcacccagccaacattttaaaaaatgccctctaaatcataaaaatgtccaacactaatttaaatttttccccttgaatcagtcagaatttctcctgtatagggatgcattctgaccgtagcacacattgggaaagtttccatttctacacagtggtggtgcttatacgctcctcagggaatgtaatcatactgctgaattaattgagctttaaaagactttgtcagtaaggaatttgataagggggaagaaaattaaacagggtcctaatattggcccactggaggagaactgaaataattaccgtgcagtttccaattccataatatcatgccagagtggctgaacaagctcacagaactatcattccctagctcaggttatggtcttagtaaatctcctgagtgtaacgtcttgaccaaaacagacaccagtggctatgaaaaagccttcacaatgaagtcacagggataaaataaaagcgacagtccaagttgaaatgccacacaagtcgggctttcatttaaggacaatgctttcctgcccctgtgcagagcctggtgtgcattagagatggatggctgatttcctagttaacctgtagcaggtggcacaactgtataactgggccctctagccataatcattttatttttctggtgcctgtcctttcccatttccccatccctaactcctctgatagttcagtaacttcatcttccttgttggtgcttggagtcatgactggaccatatttctggtgtattttatagcatcttgaatatcctggaataaagtttctaaataatgctaataatgaagtctcttgctgcctagaagtcttggagctaggagcttggctgcaaaactcaaagtaaaattcagaaaatggtgttgtcttggactgaatttaacagaaacaattcctgcttatgactgtagactagactgttaactgggccttgacatgggattggcttagcccctttatattggattaaaattgtatttttatatatacacacacccctgtgtgtatgtgggattgtgtgtgtgtgtgtgtgtgtatatatatatatatatatatatgtatgtatgtatctctctctatatatatacatacatattcttacatgtatgtatattttttcctgggatttgtcttaaaacattctagcaaagcaagaaactgaaagttgacattttccccctgaaatatgctctaatcaccagtgacagatttaaaaataaatggctgagctatttaacttggcaagattacacactcaagagcaggtttcataaatatttaacttatcatttccatattttatacatggcaagcattcacagaggcagtgagatctgtgtggagagagaaaagactgcattcagatagacctgagtttgaatccccattcaataccatcctcactagaagactgtcagcaggtattttcatctttctcagccttgttttctggtaaaatgggcaacaaattcacaaaccacaaggttattttgaaggttaaataaaatatcaaacaaataccattgatgacaagtacctgacacatgagagttgcttgggaaagtaagttatcttctcttttaccaatattcaagatactgtggagttgcttggcactggcagtatgagtacattctgccaacttacgtggcaagttgattaatggatatgaccattataacctggtcttagagagggttcagctaaccgttaaagatgcccagtttcactgtgcctgaagcctcccctcccactttcttggccctaaggaaaagtcctgatatccatcggttatttattttcaactcctgggattccttcccatgattacagtagtttgatctctcaatgtgacaagaaaagctgaattattgaagaaaaatctcccagtccttcaagtgtaatttttttagattaaaaggagcaaccgcatttagaatgcttatgctaaaatgtattcattgtttagttggaattcaaatgaactgggtgtcctgtaatttgtctagtaatcctacctgttctaggtttctgaaatcactgctttaaggcaggcccaatgcctttaaaccaatcactgggccccagtaagccttttatctggtaggtaagctgaataggggtggagtgtgtgtgtgtgtgtgtgtgtgtgtgtgtgtgtgtgtatgtgtgtgtgttcctattacaagtaataaatgaaaaagtcatctccattttctcaaagcagcatcaactttagaatgagaaagttgcataattgagatgagaacctaccactgtctttctgacctaggttatatacatttagcattgtacatacgtgtgcacccttctgcagtatacatctagactggcaattgacggagatatgctccaagagagcaaagcagtttctccttaagcctacttctagtctggcctgctaactacctattaatgtttttctgaaatttaaaattaaatgacactagagtgaaataagcaaccagcgattatagggaataaaaggtactctgaacacatgggagtgatgatagagtctatgcatcccaggcacaaccactgatcttccactatgcatgaataaaccttttaagactctcagctactttaaaatattttgcctttcccaaccttaaaatattttttcagatgatccctaggaaaaaacagtgtctggaaccacaagccattatgaaatccttattaagtacacatgtaggaaaggaaagtcatcaatgcatttcttggctaacacaaatgtagatcagaaagacttggagtaaaatctctgcaactttacacaaagtgaagaataccataatttgtatcaatatccatgctattcacgtgactgccctttcaccacttgagaatcgtgtaaaaatttgctcagctggaaaagaacatgacttctgaagaattttagagatgaccaaatgaaaacaaaaatttctcaaattactgtcttatgatagtgagaatgaaaaaaaaaagcacagataggaactagagccaaagatggattagaacagaaaaataaaagatgtttgaaaatgaaaatagaaaaatttccagtttctgattcaacatgtaagaagatcagaagttgtcattcccatacttatgacatgtaaaagttggacaaactaaaactcagggacttttcttggactcaccagacacctgagtttgtgaaaatgaattctgaaaaactagaggctgaaggaactgtacgtaagtactgtactctagttgataaagtactgtactctagttgataaagtacttattttccatggagatatgggttaacagttctgaaatcatatcatatatagtataattgaatgttttaagaaactgatggtagttggtggaagccagatttgttgaagtgagagtttagagatgagtaaggggaggagactagaatgatccatgtggtaattaatggagtagagttggatacaacagcatgaactcctatttagatcgacatatatatcaatgtttacatatggaaacatttatagatatgcatatatacatggaatagcatattcacatgcagatctttgccctgtcagttgagagagcctagaagcaacgacaccccagtatctatgagcacacctgtaactcagatcttggtttctaaaactattttccaatttttactggagccagggtcccttgaaaaaataagtggcttattctaggactacagcagggaatatacaagatgagctggagcagcttgccaggaaatataaaaaatgctaaaaaaatgacaatgatatgggcatgtcataatattcagaagccaactggaagagttcccaattttcaaagctggaacaatttgagcaacaaaataaagttagattggactgtaacccagtgtattaaatggaaatccatgtgcatatgttggtataaaaaatgattccataagtaaataaacgggaaaaatagacaaatctctcatgcagaaaaatttcaaataatttattttgctactccatctacataaataattgagatgaaacgtaacttcttactccttaaatgtaggctacacatagtgacttttcttccagagagcagtgtatggaaacagaaaaaaaaaaagtaacattacaattgagaaacctgacaagcacatgtcaagtaaggtgatcaaggttaatatcaacagtgataagtcatattgatatgctattataatagcactctatttctctggttttctctcagaaataaattaccctagtctagtcatgagaaaatcatcagccaagtcccgattgaggaacattctacaaaatacccaaccagtaattctcaaaagtgtcaaggtgattaaaaacaagaaatgtctgacaaactgtcataaacaaggagagcctgaggaaactattaaatgtgatgtggcattccagatgagggatttgaatagaaaaacagcattgtttaaaaactgaggaaatctgaatgaagtatagactttagttaatattgcttcagtgttgattcattcattgtgacgaacgtactgtactaatgtaagatgttgataggtgaaacttggtatggaatataagtgaaatttctctactatcttcacaataattctgtgagcctaaaactattctaaaataaaatatttaaacactacaaatagaataaagagaaaacatgtaaaccattatttatttcatcagtttacttgttttgaaaataattctgtgcttcttctatttcctgaattttataagaaataaatatgtgagaaaattcaacaaccagtactcaaccaagtcaggtgtgaagatactcacttttcatcttctttgcatcccaacataattatttcagctttagagaatgtggttttgttgaggcaaaagtatattttgaatgctgatgatgtaggtttgtgtggaattcctattaaggaatgatcaaatgatctggaaagtagcaactgtttttgagattcttatttaaagatttaaataatttcatggacattaaagtattttgtaaactatatagatttcagtataaatataaatcattgttatcgtgtatgaactcattaatttattttttcattaaaagataagcttttatacattgtcttctccacccccaccacccgccacctctctatatatatagagactggggggaagagaaccggaagaggatgtataatattctatatatatatatgtacatattttttaaccaagccctatgcactgaacagaactacaatttcagttttgaaactgtctttctgaactattttactcctcatcgggcagccccgtggaggttttactgtttaagttttacttcctatttctcctgagagtatagaatggcattgaaatggcagagccattcaaaccatctgaattgatccaatatttcaattcttccaacttttttggtgccttttaggataaggctatttctttacctatgtctgtctttcaggagcaggttcttgcatcagatcaattttgtgaactggtttgtttcacctgtgaatgagttacaggtcctgtatatcatggtccttctaggacccaccctcatcttgataaacagacgctggaggtttagatgcacctgtggatgatagaggacactcaactttgcaaatggaatgtgttgtctggaggatgccatcatagaaacatgtggttccacttagtatttagtgttttgaacagatattgaggagcaggagaccctgaaaggtctccatagtgagagtgtgccaaccagagggcatgttacttcttttttacattcagttgtctcactagcacctcaaactcaacatagccaagttgaaattatcatcctccttccatattgtcccatccccctattcctgatgaatgacatcaccatccatccattgaccaaattgcaatcgtatgagtcatctttgacacctcctcctctctctcatctgacttgcaatccccaaatccagttgattccaatgttcctaaacatctctcagagtattcaatgccatttgactcggcagggaaatgtgataaacaataaagctactgtaacagcttactaatattgaccaaaggtcatccccttccaatccattctccacagaacaaagccattctaaaatacaaagatgatcatgccacttcctgcaatctcccagccatgcccattgtatgactcctatgctgaatgactttaagtttctttaatattacatgctctctttcccactgtgggttctacagatgctgtttgctgtgtctgaaacatcctactgttcctctctccacttaccaactaagctttcatctttcatcctccacctaatctctactctcctttcaggatcatcagaggtattacctcttacaaatatctttccctgccttccaaatcctgtctccaaagcctggattatgtacttattataggttcccacattgcactcagtacattgtctccaccctctactagcttggaaaaatctgcgagagcaagaagtatgtctgttcatgttagagttacctctaatgcctgacttgatacctgacaacatagtgttgctcaatcaataattgtaaatacctgaattattaatgcatgaataaataaatgatttggtaaatatacaaatgtatgtattaaaaacaggagagaaagaaatggaaatatttgtataaccagaacatcaggcaattagcattaggaaagctttttttttcttgtttaagtaggttaaaacaggccttaaaagacaaaaaatcgtggaacattaagatctctctcctttcccccctcctccttctacctgtgtgtgtgtgtgcacgcatatgtgcacttgttaaaggtagagagagggccgggcacagaggtcaggtgggcgggttgcttgaggttaggagttcaagaccagcctggccaacatggtgaaaccccatctctactaaaaaatacaaaaattagctgggcatggtggcaggcacctgtcatcccagctactcaggaggctgagacacgagaattgcttgaagccaggaggcagtgagccgagatcatgccagtgtactccagcctgggcaacatagcgagactgtctcaaaaaaaaaaaaaaaaaaaaaaaggtagaaagagatggtgagagaaaattgttggcaagattccagtttctttccactagaaggcagaaagcactaaacaaatgtcaaggcagggacctaggtttccagaacccaaaaggagcattgggagtttgtcactgagacctcagaggcagagcccaagaccagaaccgaactattactatgcggacttgatgttcaatgaatcaatcgcctaagtatccctaaatgctccactaccctgtgcctctctacaaaccccattataattcattcccaagccatgatcagaattggctcatcagtttgtgcggtggtaatgaggaaggggtaggaagttgggattcagtgggtctaccataaggcagaagaggaagcaaatcagacacattccaatgatattatctgtttggttttgcccatatctgattttcgaagtcttctatgtactgaaatcaaatatctcacattaaaaaaaaaaaaaagcttttaaagattgtaggttgacacagcatagaatatcccttccttcttctagaccagtagcattcaaagctacctggtagtgtaattaagattttacatatttcaagcttcttcactgtaactcacagcagcttggaaggtaggagtaagcttcatgacaatgatcctctgcattttgatgggtacaagctgttctttgatatcatggacaccccagcttttcaaaagaagattcttggctgtttagcagttcagccaatccatgtaattgctttttccatgttacataagagtaaaagtctcctataattatagggataaaagagacttgatactttccagatcaccagagcaggaagaaagaagaaaagcatgactttttggagtgattactcatcacatgccagacacaatgctgaaaactttgtatccatcatatttttatgccacgaaaaccctgtacagaagacataagcacccccattttacagatgagggccctgagactaggggaagacaaagaattcctcaaagttagtttacttagtacaaattagaattggtctttaaactgactccaaggaggatggccttttttactctaccacatcccctctccaacactattggtttgattttctgttacagaagtacaggaagacagtgtttcttttctagctatgcaacaatgacatgtggtggttgaaagcatggcctctggagccagactgcctgtgaccatttactttttcttgaacttgaacttatactttagtttctctgtgccctaatcttctcaagtgcaactggggttaataatggtcccagcactgttgaaaggactaaatgactttgcacctataaagagctttgtattttaagtgctccataaatattcatgttgtagttgtcattgctattgttgttgtctgtgaggccttttcacagaggcatggcctcgcagaatagggacaagcatgctttaatgctactcctgtcttcttaattcccagtagcagaaaaactggaagactcctttgccaagggttattattttttaatcaatctacgtagggtttatacatagatgatgacagagagaggtaggtacagttatttatagcctgtgagtcattatgaaaagtcactctttctttgcttggtcagagcagtgagaatacatatatctgcaactccatgtgtgtagaactagcagcttaaactggaaagatgacctattgccttagtctttcccagagagaggcttgccctacacccccttttgcagcctgcccaggctaatgcaactagcgatggcaaggcaagcagggcaggctgccatgcattttaggggatttgagcagtcaggcagatcattcagggagagattgttttaaaggtttagctaaaagccatttatccacctcatttcaagcacagtattggctccaaagtacagttggtcctccatatccatgggttctgcatccatggattcaaccaactatggatagaaaatatttggaaaagaaaactccaccaagttccaaaaaacgaaacttgaatttgccatatgccaaatatatcaaatccacgctaatgaagtgatgtgtaggcattgtattaggtattataagtaattcaggaatgattgaaagtatataggaggatatgtgtaggctataggcaaataacacaccttgttgtataagagactttagtagccttcaagtttggtatctacaggggatcctggaatcaatccccaagcatatccagggacaactgtgctatattgtgatgaagttccaccacttagctttatagctgaggactacaagctccaattatcttagggaatattctggtgaccaaataaataaaaactttctaaaaagtgatagtcacttgagcatccaagaagtatctatcacatccttaagtcattccattttcctttatatctctctgggtgagccatcttgtcctgaatacaatttgtaatgccgggtaattacttcctgacagaaatttcttcccatttcattctctgtgtgttaagctcatttgattacaacaaacaaaacaaaattcagggacattgattaatgcaataagagcaaaataagtaattaaaattaacaagtttctaactttgaggcctggcctctctcacagagtctgtggcaatattaaagtgtgattctagcagaataaaaacagttcttgtctcctgaaatgtgaataatcctcagtagatctgcctttggattggacatccattgaacatgtctcaactgcactgtgtctctttgtctttattttctttatctttgggtcattcccccaattctaactgacctttgttatccttctggtctccagtttagttttctgggaagggctctccctggctcagttcctcagcaccatcactacttgagcagagcttttccacctgaagtgctcaaaggactgcccatctgtccttgctcagggacccccaacacggactgcaaggctttagaagttgaatccccagcacagagctctaatcataggtgccgcagaggccttgtctccttgctggtgctgaagggtggtggcttccatagcctgacagtctctttatttacccagcacaataaaggaactaacattattcttgtggcaattcaaaaaaatacttaaaaattagtttgagacattatttaaatttttattatacatcccctgacaaaataatttttatttatggaatgtatttttttattttactttaagttctgggatacatgtgtagaacatgcaggtttgttacataggtatacacgggctatggtggtttgctgcacctatcaacctgtcatcattatttctcctaatgctatccctcccctggcccccaccccctgacaggccctggtgtgtgatgttccccttcctgtgtccatgtgttctcattgttcaactcccacttatgagtgagagcatgtgctgtttggttttctgttcctgtattagtttgctgagaatgatggtttccagcttcatccatgtccctgcaaaggacatgaactcatcctttcatatggctgcatagtattccacagtgtatatgtgccacattttctttatgcagtctatcattgatgagcatttgggtttgttccaagtctttgctattgtgaacagtgctgcaataaacatacgtgtgcgtgtgtctttatagtagagtgatttataatcctttggctatatacccagtactgggatggttgggtcaaatggtatttctgtttctagatccttgaggaatcaccacactgtcatccacaatggttgaactaatttatactcccaccaacagtgtaaaagcattcctgtgtctccatatcctctccagcatctgttgtttcctaactttttaatgattgccattctaactggtatgagattgtatctcattgcagttttgatttgcatttctctaatgaccagtgatgatgagctttttttcatatgtttgctggctatataaatgtcttctgttgaggagtgtctgttcatatcctttgcctactttttgatgggtttttttttcttgtaaatttgtttaagttatttgtagattctgcatattagtgctttgtcagatggatagattgcaaaaattttttcccattctataggttgcctgttcactctgatgatagtttattttgctgtgcagaagctctttagtttagttagatcccatttgtcaattttggcttttgctgccattgcttttggtgttttagtcatgaagtctttgcccatgcctatgtcctggatggtattgcctaggttttcttctagggtttttatagttttaggtcttaagtttaagtctttaatccatcttgagttaatttttgtataaggtgtaatgaaggggtccagtttcagtttttctgcatatggctagccagttctcccaacaccatttatttttatctatttcagggatcagcaggtttttttttttttaaaagtaaatctcaaacttgttcaaagagtaaatatctaggctttgttgacttttactcaagtctgctattgtagtacaaaagcaaccatagacaatacaaacaaatagatgtggctgtactccaataaaactttatttacaaaagcagctgtgtttggcccctgggctgtaatctgtggagcctgatctttcccagtgcatgtgtacccatgctgtgctcacaccccctcacactccatacccattttgtacatctgtgttcctttgttgcctatattgcatagctcactaatctgagaaggctggatttcaccgaattgcatgggagtcccactgttgtcaagacactcatggtctgttaagtggaggaaaaacatgaactatctataggagaaccaatgtctcagaatcatcaacaaatgcatgcatttgggagaaatttctagtattctaaaatggatcgttttatcctagaaatggtgagaatggcactctcatcacacaaagcacacatatctgcttaggtacagacatttgctgaatccgaattataatgtcctcttctgccaaccctgtaagatgctcacatgctaatggtaggggtggaggaatggtatgaaacatgaaatatcttctgctttgacaactgtcttaactctgttgttctctcctaaaatgaagttgtgctttgagccactctatctaaaactaggctgtcatttctatgtcctaagggatgcaagtaccgttttacctttcagaaagcaaattttaaaacaatccccaggtataagatttatctttccgagcagaggatctgcaaacagtgcctgcggacgtgtttactggttaaattttattccaactatgagctactaagtcttccagcaattgttctttcttaacaagtttgtcttccttggtgactgatggtttctacttgttcacttgatcagtgtagcatttgattccaacagaaatgtgcagtggctcacccctgtaatcccagcactttgggaggccgaggcaagaggatcacttgaggtcaggagttcaataccagccaatgtggtgaaaccccatgtctactaaaaatacaaaaattagccaggcatggtggttggcacctgtaatcacagctatggtggctgaggcaggagaattgcttgaaggtgggaggcagaggttgcagtgagccgagattgtgccactgcactccagcctgggagacagaccgagactccatctcaaaaaaaaaaaaaaaggaaaaagaaaaaaaatgaatctttataatatacaacacaaagagggattttgatgggcttttagttctcgcagacccccctgctgggttgcctaaacttgtagtggcaatagagcatccagaatatctgcccatttcttccttaggtacatgagcttccctgtggctttagatcgttcataattgttgggttcatccaggagtgtcactttgtgaactttttctcaaggtaataacatgtgtgagtagcacgaggcattaaaagaaagaagagagatgggagtgtcctttagatgtcctcagtactgttgttagaacctgcacaccagttttttattcacagtttccccttgtgtggcaatttatttgcagtgtagctggtaatatttgtgacatagaatatgttatgctatgacgtacctactatggttagcatagtggtggaatttaagaagggatatttaattaatagaatttataaacaggactatctgtcttcagagacacttcagggataacgataaacttcagagatactgagaattgcaaggggatctcagtctaatgacttttgagtgccttttcggatgtgaacaaacccagcaatagggtggataatatgccttaactgggtccccaagatacttgattgtgtatattgtctggatgttcaggaacacatggtcttaatttcttagatgtctctattgtgtgtgccagtttagagttcagtctgggtgcatttatgttatatagttttttccatattttcttttagggtataggaacaaaacagtcagcaaaactgccaaggtgcttgcagatcaaagtgaagataaaaaatgagtggagtgattgcaacacaaggtgacacttgatccaatggaggttactttcactggctttcctagaagctcatactgggaaccccatctatgggactcgtggtgggtggtgggggatgacagaaaacttcctcttcatgaaaatcttaggtctaaatgacatgcttatagtttggtggatggattgagagaagcagggaggcctttccaggcagaaggaacaaaatgtactgtcatttggaagtgacagcaggatgcactgacaggagcctggagcagagtataggaggcgatggcaaaaagaaagactcacaggttaagacaggcccagggcatgaaggacaagcagccactgcacacatcccctccactaactgctttgttctgctccctcttgcagtaccaatactatccaatttttgtctatactagaaatttgggagccatgcccgatccaatttccttcatatcacccatttactccatcagcaggaatagaaagcttaccaactttatttacatattcatccatcctttattgataaaataaatttatttttgagatactttccatctgacttcaaggttaaataaatgttaatgaaggaggtaatgaagcaagacatgcttgaactttggagccagacacaatttgggttggaatcttgcctctacctttcaccttctgagtatataaccttgggaagctgtcttgggatcttcagacctcagaaaagagcacaaagaagttaattatatgttcctcagagtacctgccacagaattattaaatattcaatagtggaaattcctatatcctcacttctccttctagttttcatttctctcctgaaacttcgttcattgcattttgaaaccttcattgactcttctattggattttgaggtccttgagggccaaggttattgttagggcttttttgttttgctttgttgttgttttttaataaaacactttctgtgtttatgtttctagttttgctcagttttggtttgcacgggagtctcctgcagtctgccgtctgagtgcaagagggaggatgaatgatatccctttcagcttcctcaggtgtggggaaaagattaggaaaagagcaaacatttatggcaatctggagttacagcatgtgtttgagtcccaggtattttcctcatacatcgtttagcctctttgagcttttgtttcttcatttgtgaaatgaagataaaattcttctaccttatctggcctataggatcatccctggatatttgccttgaacagtttacagtcttagctcccacctgcccatgggaaggaccacagggatcttgtgcagcatccccaaatcttctgcagcagcactccaagttccatctccttctctccattccttcacctgctttccgacaggtttcattctgtggccagtactttgttttcctctctatggcggctgtttgaaatttaggattccgtaggacagccttcttactttgcaattctgacctcaccgctacacaccatagttcacattaccctcaccttcattaatgtctctaacagcaacaatacaaattgagtaaattcaatttagggtgattgagatgtcacctgtttttattctttccataaattcaagcaagatatgttaacaattgttcggatgtcataatgttatgctagaagttattgggctctttaattgaatgttctcttaatttgggcattggtaaggtaccaatttgagtatgcagacttgatagctgggtttgccaccaccctgagctagtagtgtatgtggatggcataaagaacatgttggatctttccacctctgactggggctctctgtggccagcatccaactcagcaggatcagatgattccggaaacactgactgcttctctcctgcaagctcacagtggagcgtctggcactccctgagatccctgccctgcatggctttttacacaaactgaacaaatcacattctctaaatgagagaagtgcagctctgttacatttcaatcttctaaagaggaggaaggtcactcgtcagagaccttgtggtcatcagcaaatagggtgatccaggatgaagacacacaggcagtaaatgacggtttcttcctcctctcccttctcctcctttccccttgatatccagtcttatcttctcccttcctttctaactctccttttccaatctgttcttcactcgcctttcttctcttctcttctttcccttcttctctccctctttattcttcttccagaaatctttaaatgagtcatgattcaagtgaaaaaagattcttagctaactcacatatggaagcagcaaattttctcagattttgagctccttgaaagctgagcagcataggagccttcacaaccctgtagtccaggcagcagtagaggcatttctctccagttcctgggaatctcatccgacagtcaacttgtgttgacagagtgagtaggactgtggcttttatttatttatttatttatttatttgcatctggatcttgggaagtaagcatgtggcataagctgggtttcttacattgccctaagtcattgtcacaagtagaaagaagtatggttgtacctctgctgcacaaccactcaggcaactgttcctaatgtcttctctgaggccttctttgtcacttcccaagtctcaggtatgggcaaattatcctctatcctaccccattatatttgaattccaatttgctcgtagttcattaacacctaccacactatttcctatttattttgtgtccattcgccagctagattgcagaagttgtgtaattgtgcctcattcgtctttatagccaaagtataatcctagaacagtttctaatgtcagatgcatcagggaacccaataaatgtagatggtaacgttatgctaatcttacattttaattctattagtggtgaaatctttatgacttagtcctgtgagttgcattgaaagattgatctaagcacctcttttgtgttggaaaggagatatattttcaaaatttttaaatattaatacatttttagcatggcatatgatcgttttgaaatacttatttcaatatcccatgttctaaaatagagtgtattaacagaaattttgagatgtggtaaggccaactgatcatgaaatgattgccattgaaaagataatggtcttgagtatggaatcccaaaaaaggaggtaaatgggggtctgggctctggattgggttggtttttatttgaaaagtgtgtgctcgggcaatttattttctatctctaggaactggttagtcctgagaggggaaattccttcagggtcaggaagaaccagatatcaaagaatcagaaatacaaaataaaagatagacttaatgcagcttatgatgccaaaagagattcacttttctctaaacatgaatgggcatgtagaaaaaacagcaatctctacagctgtctgggtacaattgctgtcacaagaactattgccataatgcggttaggacataaagtaaacttaaatactctacatactttttataattggaggttgtctacatagacacagtagagacttgagaagtccccagagaccttaaaattctattcagttcagctgtaaccgtatcctccaatcaccttgtgggtcatgtatggattgtcttgcttctgcatttatcttccagagatttgctgcttttactaattattggagtagcagacacctctattgcttctgcctctcttgaactatgattgttcttatctctgggtactaagtccatcatccttagatcctgtagagcactggctgctgaggcacacttatcaccaaacgcctgttggtgtcactacagagtaggaaccaaattgctctcactgctggatgacaacttgtttctcatctagcatcctaacttatctggtaaggaaatggataactgcagtatataattattgtgtatcagtaattaactcctcctgccctctgtttaggtaaaagagatgaggcttaaaaggcgcacaatttttaaatgtcaaaagtatcacttgactcaaatctttctgaacttagcacttacaaacttttcagtggaccacaatgtccaacattaaatgctggaaatcaccataccgtgggtttgtaaaacaggccaatattttttttatggatacttttaaggtccatcctagaggcctatttatataaacacttcatgccttactctgggaacttatcactaagattttcttcaaagacctggtgaatcaggattttccattcatatctgtgaattaaggatacctgggggtaatctctgtcactgaatacatcaatatatttgccagttagacctcttctttgctggagaatgctgacttgcactttttgtataggtaaggtttatcaacaagatttgtacaaggtcaagattgggagagctgttagtctgagaaatgccaaatatcagaatggggaagaacgagatcgtctctagaactcctagttactcagaggcattttatttcatttctttcatatgatttcttctttctttctttgttgtcttttccacacaccttacagatgatcagtattctatttaaaatgtacttaccacaagtacacaaggctctttatctcaacagtgattatagttaggcaatagtagaaataaaataaatgtccatatgactttaccatatgacagaatattctgcagccacttaaaaggatgagatagacctatgagcactaacataaacaacgcccatgacttattacaagttttagaaaacaggtaatctattatttataatagcaaaaaatgataacagtaattctatgttattatttttctctttttttttaaacggagtctcgctctgtcacccaggctggagtgcagagtgcagtggcgcgatctcagctaactgaaacctctgcctcctgggttcaagcgattctcctgtctcaacctcccatgtagctgggactacaggtgcgtgccaccacgcctggataatttttttttatttttaatagaaacaatgataaatgagccatagctacctgcaacaacatattgaatcttataacataatactgagcaaaaaaaaaaaatctagacatataaagaacatatggtatgattctatttacataaagatcaaaaatagatacaactagcttttggtattagatgtcagtttaatagttacatgggtagagaaggtggctagtaattaggaagcagtgtatacaggggtatggatcatattccatttcttggtctgagcattgagtacctatgtgtgttcattttgtaaaattttctcacagtgtaaatttatgaattatgcatttttgttatgtattaacctttaaagtttattgtaaagggcaggaatttgaattttgaaaaaataaaagattgtgatgtttcacaacatggacagtaatgaaaggatattcttaggtgaagtaagagatgtggttcagcaagaccatgtgcaagtcagattccaggggaactagaaaccatgagcatgggtgaaactgaagacattattaagtaaaataagccaggcaaagcaagacaaataccacatgatatatggaatctaaaaaaagctgttctcatggaaattgagaatagaatgatggttatgagaggccatagggtttagggggaagatggggtcggggagatgttggtcaaataatacatatctgcagttggatagaaggaataagttcaagagacctattgtgcagcagggcagctatagtcaatgatgatattttgtattgttgaaaaatgcccatagagtgtatattcagtcttttccccacaaaaatgataaccatgtgaggtaatgtgtttgttaatcagctcgatttaaccattccacaatgtatatatacttcaaaacattgtacacaataaacacatataatttcatatgtcaatttaaaaataagtaaatatatttaaaaaaattaaaaagacactatgagcaagtagaggaagacaactgttaaacataggagtaggttacaaagcaggcagtggaggggcagggataacaaaatctccaagaagaggggtgagccatgctattggatttccatctgtagtttacatatatccttaagataaatctttgaaaaatcaagttaaaatgaattaagttgaatattatcagcactgatatttataaaagagattatatatttattattgctgtgactatcattattatgattcgtggagcatcagtatgactctgtacctgaaactaatgagtttgactacaacactcttttaattcttcatttttcttatgcacttgaggaattggaaattgttttcaaatagtttacatgttacctctcaaattcagtttttacaatgggttctatgatatattaaaataatggtaataatatagtagaaaccaattatattttattaacactggaagtgagccagacactgtgctcagtaaatgcatggtacaaagcatctcatttaatcttccagtgacccagtaggcagatattatgatcatcaccacatttcacatcaaaaactgagtcatagacaggttaaataaaattgccgaaagtcaggtaaatagagcgagaccctgggaacagatctgtgctttccgactatcagtctgcactattcaacgtggtagccacaaacatgtgatggtcattaaaagaaaaactggagaaaagttaaatttaacagactttaatagagcaatttgtgaaggggtagccctctgcaccaaattacattcagagtgactttggcactgccggaaggtgtaagagaatttacggaagcagggaatttatgggagaagggaaagtggcctacagaaaacagaagtgaggtacagaaacagctggttatagtaactcggcattcatttgaacacagtttgaacagttgactgactgtgattagctgaaactcagtgattggtacaggagtaggttacagtctatttgggcatattgttaggttaaaattcactatgtacagagaaaccattagaccaaacttagaatctgtaaggaggcagttttagggtaaaatcagcacagttgaacacttgaaacatggctagcctgaaatgagctgtaagtctcatatacggtaagtctcatataaaaagccccactggatttcaaagacttagcgccaaaacaatataaaatatttcattaatattttatagctattctgtattgaagtgatactattttatatatgttgggtcaaataaaatgtataattaaagcgaatttctcccttgattgactgattgattgattggattgcttctacggtgcctactagaaagctttggaagctgaaattatacatgtggcttgcattatatttctgttggatcatgctggtccagactggatgctctacttctagacctgaggttttcaacttcagcgctttaggtagatttgaacgtacacagatctagcttcctagtgctggaaattcagatctgctctgggctggggttcagttgttggtgtatttgagaagctcccgaggtgtttctaatgtatagccagaggagagaacccctgcctggagtccatatgcctgctctatgcagtctgatatccacctgactcgagacagctcctgatgggatagttacaacttaagcctgggaagtcaaatagccacagggctctcagcctgcgcacctatgcaaagagctgactttgctgattatgtttgtagatcttccaggatcactgccaatacctgtggtaaaggagttagattcctttagcttacacctcatctgtctgagagaagtgaagccccattacaccaatatggagaaggttgtgtgttaccttggtcctgaatgttctgtgaagcaaagttaaacggtctttagtgggttagaatccctactccatctaaataggtcacagctagaagattcccttaaaccgctgggtcagattctccctgttgtcaagaaaatgaaatgttattgttccaagtcacatgtcttgctcctagaatgtgactttgccaatgaacagtgaatcctaagtgataaaacctagaattgagggtaaggagtgggggacagctattataggttcaggaaaaatggagttaacagatcttttaaaagtgaactcggacaccacagactgggattatcttagcattgaaaactcactggtagatataacttgatgcaggttgctttttacttataatttatttgtggaagaaatagcacttggaaagccagtgcatattagacatattaatgagaagacccagggcttttcattttcttttcaaaatatgtcttataacattcacttatctatagtcagccagagatgcactgtttgtgaaaggaggggaggagataagcggttattacaggaaaggtttatatttggtgggggtgcaggggaagaaaggaaaatgacaggctgagaatacagatgtttatgaatttaaactgttatttacccttaaatatcaactttaactgataatgcacatctaaaagcattttgcgtagaaataagataaactatagagtatcaacattattataaagtaattatttcagtttttcctttgttgttgttgttgtttgttgttgttgttattggttttttgttgttgttgttgttgtttgagacggagcctccctctgtcacccaggctggagtgcagtggtgcaatctgctcactgcaagctccgcctcccgggttcacgcctttctcctgcctcagccttccgagtagctgggactacaggcgcccaccaccacgccctgctaatttttcgtatttttagtagagatggggtttcatcgtgttagccaggatggtctccatctcctgacctcgtgatccacccgcctcggcctcccgaagtgctgagattacgggtgtgagccacggcgccccacctttcaatgtttttttaagtgtagtattatgcagttgactgcaaagagcaagaaaatgaatccctagggtaaatgtaactttctacctcctcccccacctcaagaaattgctgcctctttttattgccccaccaagcagaagaccactggtaaatgtccttagacatccagctcagaagctattgagttcaccagaggcttttgtagtgaggccctagtgcacagccagcattagccacatacaactatccagaaataaagatcatatccttgtccttgaggggcttttgagaaatgggtatgtgcatttttggtacaagaccatgcagttatggaaaaggtgcaaaaggaatgcagaagggaagcttgggaagaattttcaggcttaatagtatttattctgagcttttagggatcggtgggcagattaacttgctagggctgctgtaacaaagcaccacaaactggtggctcacacaattcttttgttttccagttcttatcgaggtattagcagacttggtttcttctgagggctgtgaaggggtaactctttcttgcctctttcttagcttctggtaattggctgtcactctttgatgttcctaagcttgtagaatcattgccctaatctctgacttcatctttagatgatgttctccctatgtgtgtatgtgtctatctctgtgtccaaatttctccttttactaaggacacagtaatattggattaggatccattttcatgacctcatcttaacttgatcctcttcaaagaccctttcttagtccatctgggctgcataacaaagtaccctacactgcatagcttataaacaacaggcatttatttgtcagttctggaggctgggaagaccagggtcaagatgccagtaaattgggtgtttggtgaaagctcagtctctgcttcataaatgatgccttcttgttgtaccctcacatggtagaaggggcagggagcttccttgagtttattttataagagcagtaatcctatctgtgagggtggagccctcatgacttacccacttcccaaaagccccacctcttaatatgattccatagggcattaggtactaacatatgcattttgggggcacaccaatattcagaccatagcagacgctatactcaaataaggtcatatgcatatagctactggagtcattacttcaacatcttttggaagacaaaattcaatccataacagtgggagtttcaagtagaaaaagggaaggtgcttctagcctgaataacacagtgtaaaagacatggagccttttagtacctcctggtcatctcagcttctctgcacttggatggtgggactggaggccccccacccccaggcagctttctcagggttgcttgtagcaaggctcagggagctggttctgtcttcctgatattcttattatatgcccaccctgccagggtgccaccctctgtaactgccccaccctgccagtgtatgtttgatctcattgatctcatggtaaggattccttttatttgccttcaggctctcttttaactaaatgaaatacttgtttaaggcatttataaggccattgaactctttgttcatttttatctgcaagttaaaaaaagcatatcctgatttctaaacattctaaatattctccttttcattctcttttctgatcaaggttcatttgcaactgcttataagctcctaatattttaatctatcccaagcatttgttgatttttaaaaataaaattcaggagacctgctttatctaacaataattaatgctggattaaatgcacttaaacttaatccagttaaaatgaggacaaaaaagtcagagtgcaaccattagggagagactgacctacacagatgatgaggttggtttgatggatagaaataaatactagaattaggcagggagaaatgctggagtgaagactcatttcataaatagtgggttcgttattgaatattgttgtattatgatgacttttgcttctctatgtagactcttaacttcagggcctcagataatgaatacttggatagaaaggagcctctgaggtatagttggttgatttttagaatgactataagagtaatcatgcttcattttgatacctagtggcaacacataggatctgatttgcatatcttgagtatgcgggtttccaggtgaaacttttgcttacttatatgacatataggtttgtgtgtgtgtgtgtgtgtgtgtgtgtgtgcttcaacctcacactacttgaagatcagcacatttatggacatcatagttgagctcagtgtcttttaggccaccctaaaaatggtggtacaaaggaaatgttctcaagaagcactagaatcctaggtccctatacctggaggggatatggaggtgccatttagaacagttcctgttccctcacacatgtaggagatcatgctgtatcatggtctcccacacctctgtcctccatacagagatctctctggggaaatagtgtaacaagaactatgactgtgattttctttcggtagcattcttttttctacgtagtacagcttaacaagtttctatggagagactttgagaattttatactgttgcagtttccaaaagaattaccataaggctgtgttacacatctggatctgaactatggctgcccagttaagtagatatcatgctagccaataagtgttccaaggattctgtgtctccaaggacaaagagcacaatttatttttcttaaagggagaagtgagggagagtatgaaactagagaaagtaacattatggtgaaatttcagaacccagcattagaacagtggagagaatctttttggcaggcagcctggcctgagccttgcccttgcccttgccctggactcatctcactccaggactcatctcactccaggagcagaatgcatggttgttgcatgcgtctgtttcaccaccagctgtaactgctcttatcctcttatccattgtctttaccaagaaaatggaagaaatactacacacttcctatttgtttatctgtgagggagagtgtgaaagacagagcccattccccaaagaggtctgcttgtattacatccctcaaaatttctgggcaggaaattcaaaaccacaattgagaaatatagttaccaagagtgaaagtacaagttaaaaaaaatgagttaaaaaaaaaagacataaaaataaattccttaaataccagtttctggacacagacttctccagagttagcaagtcactgactgcctgtggctaaggctagttttgcatatgggagtagaatattttaaaggttctttttgacttaatgctgcttcaagagaaaacggaaaaaggaaagaaactggcgttttgtgcatcatttatatgccatgtattattctaggcactttgttcgtgcttatgtgtttaatccctaaacatgcaggtatgcaatgtttttctattttattggtaaggacaatgaataagaggataagaacagttgcagctgatggtaaaagtcaggcatgcataaccacggaccacactgctccttgagtggagttggctcagggtaaggggtgatcttagccaggccacccttggtggcatggctcaatccaagttcaaaggcctcagaaccagggaagccaatgatgtgattctcagtctgaggccaaaggcttgagaacccaaggtcattgatttaagttatagggtccaaaggccagggaacctggaatttttgtccaagaacaggaaaggaggagtatatctcagttcaacaaatagatcaacatatttgcattttctctcattttgttctcttcaggatcccagaagatgggatggtgcctgcccatattgaagtcagattttccccatctagtccacttagatgaacatgctaatgtcctctgaaaacatctacacagacataccccaaaataatgctttattaggtttctaggtattccatgttccagtcaagttgacacctaaaattagccatcacacaggggggaaaaattttaaaatatagaaagatgaaaaaccagaatttatcgaattactatgtgctatatgcttaagaaaccttacttgatatcattctcattataaacatacttgatattgcctttatgtagggaggaaattgaagtttataaaggtaaagtagcatacttgcagtcactcattttaaaagtgaccaaaattaaagtcaaatccaaaattaccagactctcagccccttgatttatgctggttctcgcataataccctatgaatcaaatgcactgataatataccatcattgtagctacacctgggtctataaattcacttgtagtctttgtagttttaatttcactcttgatttaaactcagaacctttttttatttttgcatgtccccaggctacatttgactagcttcaagtaaaaaacaaaacaaaacaaaaaacatactgcataaatgttatgtggaaataattcatttttgtgagtgcagtcttatgtttttgtttgttttagtgggcattattctccataatttttataattctttttatttgcagaagcagggtagacagattattatacgcaagtcatgcttattccatttcagtcatgaactgacaattaagtaaaatggaattcttaagagttggcacaaatatttatttgtttccaagttcaactggaaaatttaatgaacttgcaaatgtgggggtggaaaggatgacattttttaagatgatgatatgcctaaacaggtcttaataatacatgttttatcccttcaatttgaatctttccaactttaaaatgtcaacccaagcctgctggggcacatgattgcccctctcgacttactaagaaatgtagacaatgtgatattttttaggtttactttctgttttctattatgccagcccaaataaatgcattaaaaacaaaaataaaccctaagaagagagaaaatgttcgaaaacatttgttcccaacataattccacaggaaaaagtattagaaaacatgaggtcatatcttaagagaggatatagtgcatggtctcagaaaatagaagaaataaaggaaaataggtcctagaatgtgggctctctacatgtaggttttgatccagatttgtttcatcaggcttccatttgcttattaatgataaagtactgcaagtacctttactggtagagaaacaccacaagtccccatggactaatttcagctgaccctggaagcttctgcagcattttgggagcaccccagaaagtcacggtatgaagaattttgtgtacctgagccacccctcagcttgcttttctgtctttgaattgccatcagcaccaaatgaagctagtctagaatataaaaccaggcagcataccagtgtcagcattagagtatgttggttggaacagcacacaaatccaacacagagataaacaatcagaatacctacatatcagttgatcatgctgctcatcctctgaggccagggtacaagtgctttcaccattttccttatggttctttgtgctgtgaaaaggactttgtgagtgcagaatcacagtgaggagaccaaggttggatgaaaagtcccctgttttagcctataactgaataccacaaaatgggtactttattttgaaaaaagaaatttatttggttcatgtttctggaggctgggaagtccaaaagcatagcgccagcatctggtgagggcagttctatggcagaagggggaaggcaagtgagctcaggagacagagagaggaaattgagctgaattcatcctcttatcagaagcccactcttgtgataactaaccccctcctgtgataactaaccccctcctgtgataactagtttactctcatgataacagtattaatcccttcatgagtggagccttcattgcctaatcacctcataaaggccccacttcttagtactgttacaatgactattcaatttccaacacaggaactttgaggaacatattgaaaccatagcagctccaaatggagaagctgggtacagagtttggatgtgggtggggtcagaagcagatggtcaactcacgaaaggaggatgtgtttaagcctaggagtacctgatatcaacatggacagattctaagccttaagaacactctggggtgagaattgatgtaacatgaacaattctgtaaagacagaaatatgcatttgttaattcaagtaacaagtctgaagtgtcaatgatgtgggaattgctgcactaggtgctgaggagataatgatgagccaaatgagtaaattaatgaagaatatggtcccctgaatcagtggagcttactgtgcaaggctttttgatagtgcaaggctctttgaactagtgacatttaatttgagatttaaaaaaaaaaaaaaaaagtggagtggtcctttaaaagacaagcagaaggcgtggagcattggctcgcgcctgtaatcccagcactttggaaggccaaggtgggtggatcacaaggtcaagagatcgagactagcctggccaagattgtgaaacccggtctctactaaaaacacaaaaattagctgggcatggtggcacgcacctgtagtcccagctgctcgggaggctgaggcaggaaaatcgcttgaacccaagacagggatgttgcagtgagctgagaccataccactgcactccaggctggtgacagagcaggactctgcctcaaaaaaaaaaagccagcagaagaataaagcaaacagcatgtttcaagactctaaggactgaaatggtagacataacagaaaaaaaggagagtggttgatatgggtgagcagtgtcatatcaggcaggtctttcagaccatactaagaattttaggtattataagtcaaataggaacctaataacacagtaaaaatagaatatacacacatattcattcatatacatgcatatatatgatttaatttatatattaaaaggtttatattgcctgctacatggagaatggtttatgggagtataatcataaaagaagactaaaagataaaaagctatgtattattttatattctgcatattcgacatattctttgcatattctttgtattcttttgtaccctaggattaatatttttgcagctatagttgacataagataagccacctgtttataatgtatcactagatacatttttgacataagtattcaccagtgaaaccaccactgtaattgagacgattaacatgtctgtaactcccaaaagtttccccacatcaatttgtaatctctcctatcagtccctactcctgtccccaggtatctacatacatgttttatgttattatagtttccattgtctagaattttgaataagtggaattatacaacatgtaccctgtttgctgtctgatttattgcactcagcatatttattctgatattcttccatattgtagtttctatcaatagttcatttctttttactgctgagtactatttcattatatagaaatgtaataatttgattatccatttacctgttgatggatccttgggttatttccagtttggggggctattaaaaataaagtttctatgaacattgggtacccagtgaaattgaactttcaatagttgttggtaatggaatggcgagatcataaagtaggtatatttttaattttctgtgaagctactattggaaatggctatataattttacctttccatcagaagtacatgagagttctagttgttcacatccttttcacatttggtatggtaagtctttaatctcacctattctagcgggggtgccatatatctcattataatttaatttgcaatttaataataatgaacaatgttgggtatctttttaggtacttatttgtcatccagatatctttggggaagtgtctattcaactatgttttgctcacatttaaattggtttgcttatcttattattgagaagtcattcttataaattaaagatacaagtccattgttgaatacatattttgcaattttttcagactgtatcttgccttttgattttcataatggtgtctttgaagagcaaatgttaatgttgatagataaagtccattttattgattttgaaatattttctagtttgtagcttttatattttagttaagaaatctttgccaaatccatggcactaagattttttcctatgttttcttctaattttgtagtttaaactttacatttacatctatcatcctttttgagtgtatatatgtatagagtatgagattaggatccaggttcatttttgtggatatggctatatatactattgatgcaatgtcattttttgaaaatattctttcaccattgaattatgttggcatctttgtcaaaaccaattggccacataagtttcgaatattatatttcagaacgcttttatctgttgcaattatttatttgtctataattaggccaataccatatgccttgattactacagctttataagaaatcttgaaataaagtcatgagattccacaactttgttctcttggctacaggaacgttgttttggctactgtagatcttttgtatttccataaaacatttagaattggcttgtcaacttctgtgacaagaacaacaaaaacaaaaatgcttcctgagattttaatagcattgcaatcaatctgtctatcatcttggggagaattgacatcttaataatatcaagccttctaatccataaacatgttatatctatttatttagatcttcttttaagcttttcaatgtacaagacttgtgtgccttttgttaaattgatctctatgtattttacatgctttgatgctattgtaaatgacatttttgtttcaatttttctttgttgctgtaaaatgatgtacatttatttttgtatctctctcctataaccttgtatcctgaaattttcctaagcttacttgataattatactaggtcttctgtagattccatcagcttttctgtataaattgtcatgttgtttgcaaacaaagacaacttttcttctactttccccagctgaatgatttttattcctattttttcttgttacattaactaaacctctggtacagtgttgaccagaaggtatgagagtggatattcttgctttattcctgatcttagggaaaaaaacattctttcacagctagatatagattttttatagctactctttattaggttgaggaagtgccttctatttctaggttttgagagttttaatcaagaatgaatattaagtttggctatgtttttgcctctgatctagttgttaaattatctgcttagatgtaaaaatggtgaatcacattgattaattttaaaatattaaaccaaccttgcatttttgtgtataaaccttacttagtcatgatgcactatactttttatatattgttgtattttatttcctaaaatttattaagatttttgcatctgtggcaatgagggctatttatctgtaatttttggttaggtcttcgtctttttcggaatcatgataatactggcatcataaaatgaatttgaatcgattgtttttctttaattttcagtgatgagaagcccccgagatgataggaaacaatgaacaccaaaggaattattattttatttaaaaaatagtgcttgctataattgaataatgttctaattttagtatgcatgagaaatacctgaaaattttacttaaatagagatcctggctgggtgtggtggctcacacctgtaatcccagcactttgggaggccgaggcaggcagatcagctgaggtcaggagttcgagaccagtctggccaacacagtgaaacctcatctctactaaaagtacaaaaagtagctaagcatggtggcaggtgcctatagtcctagctacttgggaggctgaagcaggaggatcacgtgaacccaggaggaagaggttgcagtaagctgggatcacgccactgcactccagcctgggtgacagagcaagactctatatcaaaaacaaaaacaaaaccaaaaaaaaaaccaaaaagatcctgatttagaaagaaggaaaccataactagtattaacaaagaaaaacatatctcctcaggtgattttttatgtagatgattcatgttttgagaactcttagtctgctcaaaagttctcaaagtgtgtttctcagaccagtagcatcagaatcacctgggaactttttaaaaatgccgacattctgtactcactccagatctactaaatcagtaactctggggaaagaagtaggtgcagtctgttttttattaggctccaaggtgactccagtgcattacaatttgagaactattgttctatgttaatgacacagagagagaatgtatatagatgcaattaattttgtatatttttagaatatatatgtgttaaatagtgggaaatttcctctaaattggctgcttgtttcttatgacctgtatagaaggtctgagagtgagagagggaaagttgtgtcaggtgtgtgagtagtgtggagacgatatggctgatcattagggaaacaggaaggcaggctgatgacattgttagtgaccattagatgactacttaagctctgtgattgctgttctttattggtgtccatttgcccagtggtacagttttcttcccccattctgagctgcccacagtagaggtatggagaaggcagtttcttggatttgtgtccatttattttgccaaataggtagaagggaagacaaaagggataaagtaaatagagtatttgcaagagagtaaatgactgtagtcatggaccatggtcactgtcctatataaacagaaagatgaagacaagacgaggataattaacagagaaactgctgggttctacggatacaaagtcttgatgagatggaagaattgtttaggtagatacaggttaagaaaggacctaggagtataaatggtagtggctacagagtgaaatgtttgtttttgaattattgtcattttcgtgataagctacaaggtatgaccttggtaatagaggctgagttctactgtgccaaatcattggtattgagaaggacagagactgggtgaataaaatacttacgtgcctattgattttttcttcatgagtgatgtcaatcatagtgatagtaggaagaatgggaggctgacagccaaggactaaatcagaatcagaaaacacaggggcatcagcaccacagaaggtaaattagaaggcatcactgccacaggaaagctcagaagcacctgagtttgtttctctagctgattaatttgggccttaccacaatttcacaggcttatgtccccagtaaatcctaaagtcatagaatgtcttttgatgataaatctgtaatcgcaatatctgagtatgagttctgatgtagccatgcagatacaaataatagcaaccagttatcctgtagaactttgcaaagtaattgaatcataataagttccttgttttttccctatttatgacagaaaccaaaaagttggctttgaaagactcctaccagctcagaagtacatggatgaagatagttgctgatgcaccccgctagcatccattctaattttgtttttcaaattcacagagagtgaagaagtttatcaaaggcaggtgctgtcaatttcatgtatcatctttggaattgtcatcgtgggcatgttctgtgcagcattctacttcaaaagcaagtaagactatttctctcaagtgtttaaaggttacttttagagaaagcgctttgtgttactttaagttctcagtctgtgtgccacacagagggaacctgtggaaatgggtctagcaacaatctgcaagtgacttaggacatttttgtaaattgtggtgagtgtgtacaggcatgtacatgcatgtatgtgatgtgtatgtgcacacatgtgtgcgcggtttatctacgatgcacataatgatcattcctctcagtgaccacgaacattctatgttctttgcactgattcaccacttgctggtattaagggcttggtgtctgcctgtcactaaaggctaactcttctgaacaaaggggccactgctatgaacctgcacattatcaaccattatctatctatttctgaaaaaacaattcagtttttcataaagattttaggcaaatgtggaatatgaatactaaaaaatatacttcagtttaccagttggtatgcacatgttgaatatgccctaaagttaccttgctgagaaactagaccttcttcagataaaggtgtttatgtttgactagaaatagatgtaggccaggtgcagtggctcagcctgtaatcccagcacgttgaggggccgaggcaagtggatcacctgaggtcaggagttcaagaccagcctgaccaatatggtgaaaccccatctctaggaaaaatacaaaaattagttgggcatggtggcgtgccactgtagtcccacctacttgggaggctgagacaggagaattgcttgaacctgggaggtggaagttgcagtgagcccagatcacactgctacactgcagcctcggggacagagttgtctcaaaaaaaaaaaaaaagtagatataaacgtctctctctctctctctctgtgtgtgtgtgtgtgtgtgtgtgtgtgtgtgtgtgtgtgtgtgtgtgtatttttccaaatgaactctggtagacgtatttcatttattaaaatgatataatctgcacttaagaaatgcagataaaaatattagccccttggtttctcatgtcttaagaattttgcacagatttggttcctacagcttgtctgaaattcaagccaatgtgtaattgcttttcagtggacctataattttttaccaatttgctcttctaacatgggattaatttccaggtatagtttgtgatacctgtctgcatgttatctgtgttgattctcaaagaaaactgtgattatgattttttaaaataacagaaacttgagcatcaattcagaattagtaactattatcttcctaataaactatttcagaatgttttttagatatttagaactgttgcaaaaatagaacagacagtttctatataccttagaccaaagttcctccattattaatgccttacattagcatggtacatttgtcacaattaatggaacaatattgatatagtattactaactaaagtctgtattttcagatttccttagtattttacctaaggcccttttgttaatgccagggccccatccttaccatatgatattagctgttacatctcctaggcaactcttggctgtggcagttgtaactatcaatttctgaacacttactctttgccaggcacactgggcttcttatgtgttagcttccaatcaccacagaaatcagagttgtgcattattactgcatttttcaaataataccagaatttattttaaaatgtttatttttcaaagtcataaagaagaaaatgacagataggttctttaattttaggagttctagtttaaatcacatgctctaaacctctataccatactggttcacatagtccttctgctagatggtggagctgcgcagagcgagttaggagttactctcttttgtgcagcccatagcactttatgttctccaagaatgccatctggcataatggtcagggttgtacactagtgagtcatacttggattcaaatcttcaggctgtcatttacttgttatatttgattaggcaaattatatcgtgtctcttagccttggttccctttgtggtaaaatatgaacaagtataatatctaccttatagaattttgttaaggattaaatgcaatcatggccagacgcggtgactcatgcctgtaatcccagcactttgggaggctgaggcaggaagatcacttgagaccagcctggccaacatggtgaaattccatctctactaaaaatacaaaaatgagccaggcatggtggtgagcacctgtaatctcagctactcgggaggctgaggcacaagaatggcttgagcctgggaggtggaggttgcagtgagccaagatcgcacgactgcactccaacctaggcaacagagtgagattcagtctcaaaaaaaaaaaaacaatgcaatcacagtgtaaagggcatagcaaagtgtttaaaagagtaaatacccaatggaggcttgctgtcgttaacacccatggttttccacactagaacttggaggctgggtagctataaagttaagagcctcccctggagcacgagagtggtaatcacacccagcagggtggtagttagaagtgtctccctgctagagctttgtacaagaaagaaattccttacttaacaataaccaaattacaataaagaagcagttaatcacttatttttacagtataatgtgtagttgtaccacatttaaatgaaagacagatcatggtaattatgaaagcaaacagctggattaccaggggacttccatctttggggctgtcaatgtctcactctggacagcaagagggctctgagatcaacatctcctcctgggactcagtgaggagtcaaagtgtttaatgaaaacaatcttcaacatcagattcattagggtaggctcagaggactgcacagaagctagagcaccaagcgggacattgttatctttctgtctaccagcctgggacacagttttatttaaaaaatgaatcaattaataactaaaggcaaaaatgataaaatgatgatacaaatggaagtattttccacctgaaattggattagctatatgttcctcattagaggcctagggtgcatttccttcttctagtaccattttcaggcttggtctcccttttttttctttgcttgagagaaatgccaccaccttaccaagcacctaatttatattgctaaaagcaatatagattgtcataaaaccctggcacaagttgtgtgtgtgtgtgtgtgtgtgtgtgtgtgaattcgtggatttccttttccaaaaccttggggagaacagaatatccaaactctaccttgaccttcccttactttcactcataaaggaaagtagtttatatgcatatacattttttactttagcttagaagccccaagtcttccaggattctaaggcctctctatcactggtattcaaataagttcacttgaacctccattcgatacactgggatgtatagtttctgcccagagggagctgagacttagctcaaagctctcttgatcatttatgttctacttcccataatcacttagaccttgcctttatgattctttttccattccctcgtcacctttggcatggcatgacttcatcagaaggaatattacagcaaattctgtgtctgaggaaagatggaaggtaggtaacatgataaggaataagtaagaaacaccttgaatttagaggattttttgatggagttaactgaacccatagcaactctaaaaaacagtgaaagaaattctcttcactcccaataagctcatatattcctatacatagttaatagaactattaattgagcctgtcaagtctggccagtgtggctcacgcaatgactgtaaattattcaagtttttctctttatttttaacttatgtagttaagaatgatggggatgagtgttagagttcttagcagagcttggaaatacaaaatatgattcaactctaaaactagaattgaagtaggagaggatatgtttcaggaggcagaatctgaaacaggtaattatcacaaatgggaaaaaagaggaggataaaaactggtattatcagtaaaatgtagacacggtaacaacctgcccctaactataggtcatcaaccccttgaagtaagagattttagatcccaaaaaaagcctcttaatggcagacactctgatgcactgctgcgtcttcttcagatatggaggatttagtcgccaagtttgccagcaaacaccggtgaagagtcacctttctcaatctcatgttccattctggtattgtttacctccaatgatgcatcgatatgaggctctgaagacctagaccttttccccaacttcaggtgcaagaccatgccagcttcagagctccctctgaggtttgctgaggttttcactgagactgtatcacattccaacttctccccagcccaattctgcttccatttcttccctttgcttccacaggtgttgataccaagagctctccttaacaaaagtcctctatgctgtctttatcccagggtctgccttcccaggagcccaatctgcaacaagacaaataatgcctaacaatggattaatgatgtctactattctgcaacttacatctcatttctttctaatgcattggaccagagaaatttaaaactcaaatgaactgtaaagtttccacactgacactgttgggctaatagtattcccatgtgcaaggcatgcatcttttcttccccagagcaatgcctctcatgagagagctaatggtattgcaatcagctgctgattgttttctctgttcccattttctgggtgaaggaagaaagagcaaaaaagtgtgtgcttgtgagagaggagggatggtagataggcagaggcaggctcagaatggaaggaccacgtatcttggaatattactaagtcaggacttgagtgaaaaaagactaaaggtaagcaaattataaaaggatttaggaaacgcagtccggtattggatattgcttaaagaaaattcccttataagtttatacttccaagactctgaattggattactgcaaacatcattaagtgtttctaatttaatcccatgagagtaatggaatccttgctctgagacatgcactcttactttttcaggatgatttaccagactagaacctcctgatttccccttttttgtgtgtgcgaatgaacccctgataaaatcttgtggctgtaacatgctccttaaaatgctgatatgatagatttatttttaacaataggctatagattagctgttaggaagcaaatagattattacaacaggattaaagcaactaagagtgctagagataaaagtctcccaaataattggaaagataaaagaaatatcttaaaaaacagagctacatcacactgatattgtaaattcaaaatgggtaatgaagctcaaagcctccaaagcttgcagcaagtgctggtgaattgcttgggaagatgcaactagtgtaatcttttacctttgggtcaatgttctgattcttttgcagcttctgctcacaagactgagcttgcttgatggtatcgggaaagatatgaacattttgcgtgtgcctccacatgcagccaccacagtgtccgtggaagatagcttttatgaacttcatttacagaggaggaaatggaggctcaacaagtttaggaaattattagggtagcaaaactagtgggtagcagagtgggattcaaatcccagtccctgtgatacaataagccacgctctgtagggtgctactgactggagaagctcattgctaagaccggccatgtgctccactgacggcactatctttgtcagagacgttggaagacaggcaaaattcaagggcatgattctactgggaaagttgtcagaatcaaaatggagtcatttgtgttaaaaaccctgacaaatagagccggagaaggacatgaagggagcagtcacgtaggcaaatgcctgattacaagaactatcacaaaagtctgtgaaaaccgcagctttgcatgaagactattgcagccttacatgcacgaaaatagttctgcaaggacatatgcccagcaacttcctgtccacccttggactggcaccatcctttctattgatccttgtagccaaggatagtgatctcaaatcagttgtgtacctaacgtttcctgtcttcctagtgataaaacatagtttcctatatcgtgtgtattcccattgcaacacttatttccaaataaatattttcttttagagtctccatgtttgttatttaggtcaacactgcaaagaggtgtgcgtgtgtgtgtgtgtgtgtgtgtgtgtgtgagtgttgtgtttaatgggtaccaagtctatgctaatagatgatttctgtgaagcttctgggacagagctgctgctaaggcagtggtttgtcccatccttctggtgtaggcactgagtgacccagacaacagtcattccgcatgtgcacacaggagcactttacttgaagtccagaaccctacagcagtttcagccttttcactcagaagcggtgggaccatgagcacatggcttggcaattctgagtggtggttgaagagtgtaaactatggaggcaggttggctgggctgagatccaatcgctgccactcactgactatgtgacgtcaaacaaatggcttagcttctctgtgctttagttctcatctacttaatgggtatagcattatggcctcatcacaaagaattatcatgaaaaatctgtgaaatgatacatataaagcacttaaaaccatgtgtggcacattactgtataactagctctttaagagttaactatttttaatatctgggctcttggtaacaataaatgagctatttctaaattgtaaaagacagagaatatacacattatggtatatagtcaagttgtgcaattaagctaaacatatttgaattgtacaaatataaatgtaactctacaaatatgtcatatgtacctgctaagcccaagtcttaattgttttcctctagtcactttcccatagtatttccagttctttgcagctaaaactcagggttagagacttcttgcatctatgggggccagggcaatgcactaaatgtttgtctgcttttggggtgccactgaatgtgaattcctagagaatatggatgatatcaggttatcactaaactggaagtatttctggtggggttggaaatgagagaagggttctcttcgttagctgagtttatttaactttagcaaataacaaatatagacactgggaatgaatgagaccctgaaagtaggagttgaataaagtcatgcaaatatttgtacacgtttatttatgcctgcaggaaacaagctaaacaaatccaagagcagctgaaagtgccacaaaatggtaaaagctacagtctcaaagcatccagcacaatggcaaagtcagagaacttggtgaagagccatgtccagctgcaaaatgtaagtgacatgtctacacacctcctcctatagcctacctcagtgcttccagctcagaggtgttgggagcctgggatcagacttgtaaatatttttcagagctttatagggttttgcttaaatcgttttaacagttctgggctgggacgtatgcacacatgcatgtatgtatgcatcagataaaaggcaagttaaatttcagctcttgattacaatctgtaatataaactaatctctagtaaaaataagagcttcagttttttgtcccatgaacacttgttgaatccttagtttgtgccagaagttgtatgtgacaccaaggatacaatgtcccttgccataagggaagttctatgtaggaagaaacacaaaaacccccagaatcagaagaagtgagttccgagatagttgttgttgcagcagaggttggacaagaggaagccagtgggaggtggatgggggtagacttgggggctgcctcacaacagagtcggactcggactgggtttggaaggatatgaaaagttctatagagagtcaaagggctaagagctagaagccagaacatgcaggaagaataaagccatggaatcctaaaaatgcatgttatgttcagagaactccaagttaaggggtgtgagaagaatcaaaggtgaaaggtggagtttcataatcaatccttctaattccaagccttacagagatatcagaacttgaagttaaatgcaaactctttgcctcttacactttttgtaaggcagttttaaccattactgaggtatattgcaaaacactaaattaaagcaagagaattctgtgtaatacatgcagatatattcctcttaggttagcaattctttgaccccacacagcatccgcactttcagaatctgaggcataaaacaaaagaacaaaggccattgcataaacctagcatttgagtataataggcaatcatccaggacacattcacacccctccaaatgcttcaatcactggaaatttatacatcactggtgattctaagaaatcattacccaaaaagtcgctattatgatgtccataacagatgtactcagatgatttaatgcagaattcataaatcagagtctcttcccaggcaagttttgttaaacttctattcatggcaatgtgcaggaattgttcatttcagaaacagagtgaatggttttgctattgatttctaatgggtataatcccaccactctaaaacaaccacagtgatggagggcttcattccttagcaactggttatgtcaaagataaacaaagccagacactagttaaagtgatgaggatagattctaatcagtaacatgttagtggaatagttgaactgaacttctatttgtacggaaatggctggatttttttttttttttttttgagaaagaaagaagtaaaattatatttgtttgtaaatgacatgatcttctgtgtagaaaatgtcaggcttctgagcccaagctaagccatcatatcccctgtgacctgcacgtgcacatccagatggccggttcctgccttttctgatgacattccaccacaaatgaagtgaaaatggcctgttcctgccttaactgatgacattctaccacaaaagaagtgaaaatggccggtccttgccttaactggtgacattaccttgtgaaattccttctcctggctcatcctggctcaaaaagctcccccactgagcaccttgtgacccccacccctgcccaccagagaacaacctgctttgactgtaattttcctttacctacccaaactttataaaacggccccacccctatctcccttcactaactctctttttggactcagaccgcctgcacccaggtgaaataaacagccttgttgctcacacaaagcctgtttggtggtctcttcacacagacgcaagtgaaagaaaatcccaagagtcaaccaaaatactgctggaattaataaacacattcagtggatttgcagaatacaatatcagcaccaaaagttagttgaatttccatacattaacaataaacaattttaaaagaaaattaagaaaacacttccatttgctagagaacttaatgtaagaaacgcttaggtataaacgtaataaggtgaaaagtttgtaccttgaaatctacaaacattgatcaaaatgattaaaatcaatagacatacaacccatattgatggattggaaaaattaatattgttaaatgatgatataacccaaaatgtggtttaaattcaacacaatacccataaaaatctctatcagtttttgttaaagaaacaaattaatataaatgcattgtctcatttagttctaacaattaatttatacccacaatgtgcagaaaatagaaatgggatttggagcttgagaaaggtatgtctgtcagacagctagtaagtagctgaaagacaaaccaacatccttataactcagtggttctcaacagaaggcaatttgcccaccatcccttgacatttggcaaagtctgaagacactttggctattgcatgctgggagaagaatgctacaggcatctagtgggtagcggtcattggcgctgatgaacatccttcaatgcacaataacctccctcaacagaagattatccttcccaaaatgtcaaaagtggtaaagaagttcacagtccatgctcaagtttcaaatgggaccatggggaagttctgaacaccaagttccatcaccaagcttcccaccgcaggcatttatttccactttacagagggtgacgggttattcaggcatatttcatccttggaaaggaaaatttcctacttgcttaccatatcaggcaaatctgtctttgttttatcttgaagctcatgttaactacttgaaattctttgcaaattgcagtgtttaacaaatgaattgtctggctctggcattcctttattaagttcattaaacattcatggaaatgggtttcactttatagtcatctaacaagatgcaaaacacctcgtcaagtgaagcaacatgatactctggaaacacttgactccaaggctgcagaactggagtagattaccctccctgagaagcatctagtccctaccattgttttaaaaacaaataaagcatctgtgagtaaagatgaactcacctcctttgctgtgtctcaagtaagaaagagctaaggatagaattataacctctagaaccttcaaggcaaaggagtgaaacttctcagcctggtttagggatcagaaaagaaagtcatcaaaagagatcatccgttcttctctcttaaaatcaagagaaaatattcacaattgaaaaatgaaagaagaaaattgtatacccttcataccttttttttcagtaatcattttaagaaaggtaagtttatgggggaggtaacattaaatgagaaagaactggaagataatacttgcatgctaaagaggaataataagaatttaatgcctaggccaggcgcagtggctcacgcctgtaatcccagcactttgggaggccaaagcaggtggatcacctgaggtcgggagttcaagaccaccctggccaacatggtgaaaccccatctctactgaaaatacagaaattagccaggcgtggtggtgggtgcctgtaattccagctactcgggaggttgaggtgggagaattgcttgaacccgggaggcagaggttgcagtgacccgataccatgccactgcactccagcctgggcgacagagtgagactcagcctcaaaacaaacaaacaaaaaaaacaaaaccaaaaaagaatttagtgcctaacagagccttaaaaattggtgaaaaggcacatatttatccagtaatgtttattgaactctggtaaagcccacacttctctgtgttgggtactgcagggatagcttagaatacaaacagaagaagtggttcctgatctcaggatgttcaaaggttagtggagagaaaaatgtacaagcatataatatctttattatatagatacattaaatcaaagtactatcagagaatggaaaacgacttctgaatttgactaggggaatctcaagcctacctaaaggaggtcacatgtgaattgagttgttggcctaaaggaaaacaaacaaaggaaacaaaaaacctaggcaaacttaatataaatagagcaattattttggccagttttgaggactgcaacctgagagcatagacttaatgtaccctaaatacatgctcccatcagcagcagttacaagtgggtttttataggaaatgaagaggcagttcccaaattgtttatcaagaatttgcattaggccgggcgcggtggctcacgcctgtaatcccagcactttgggaggccgaggcgggtggatcacgaggtcaggagatcgagacaatcctggctaacacggtgaaaccccgtctctactaaaagttcaaaatattagcctggcgcggtggctgacgcctgtagtcccagctacttgggaggctgaggcgggagaattacgtgaacccaggaggcagagcttgcagtgagccgagatggctccactgcactccagcctgggtgacagagcgagacaacgtctcaaaaaaaaataaaaaagaatttgcgttaaaatagtataagctattgcttggcttatccatggttctttttattacaaattccaaaaacttgaaaataagtgatgaggcagttaggaacaaaatgtctttaaacaatcacccctgggtttggtgggggtgagtgactacaatcccacactctgtctctctgggcctgataaattttgcatacctcatatagctcacactgctctgagctatttttggtagagttttgagagtgaattgaaaatcatggaattgtttgcagggagtaggtcagaagaggtaattttgttgtagcattaattaaagttaatttttaatagttctagcctaaacgctgatttattgctttaaatatcaaattataacttattgattgaatatagattcatacattcatttatttacttaaatatagactaaagagcctactaagtaccagacaatacctattaaggaacaggcatgtgatgatgacaaaaaatgagaaagctgcttctttcaagaagtttgctgattactgcgagtgatcaatataaatcaaataatctcacaaatgtgggctctcatctgtgccaaggcctacaggaaatagtgaacggtgctatcagagcttatagtaggcaggctggggagttcatatcagaccaagaatagctcagctctctaaaaaggtgcagttaacacatgaagaatccccctggtgaagtggtaatttgctggggaggaggtggcgttttgtgctgtgcctagtgtctgaagagggtctcttttcatattattttgctttaaaggaaatgtgtgaaaattgcaattcttaaagttcttgctgctttggtgtccatgcaaaaattctcaacagcggtcgagttgtttttaattacctacattagaaatcccagtgaaatcactcttgaaaacatattgtaactatcaatttccccatactcgggctcataagtcagagtggcaataaagaaaattttgtcacagacatatttgaaccaagcaatgcagagagaaagacatttaaaactgcctaaaaatatcctcctcctgcttttattgcctagggttccagaccaggcgattatcagcactgtcaacattgctgtccaaaactgaccctactttcatttaaccttctgactcctgctgtgtgcatgtggcagacctggaaacaatgctgttattctactgccaacatgcgcctgcttcatttgactggcctattgatttcggtgcaccacctacaatgtgctaggagcaaagcaggtgggcgggcaagaggagataccttcattacctgggagcatttgcattagccggcactttcaggggggccagttggatgaatgcttctcctaggaaataacaatattaaccagggcctatgaaggagttaacaacaacaacaaaaaacacttgagctaatgctgagagcaccattgaatgaactggggcatctccttattcactgctaacaggatcttttgtatattataccaaatgagctcttaaccatgtgcacacaataaagtcaggatctgtgtcaaggaaataacatagaatcaactgccaggctttgtaacattgtagaggatgctaatagggagatccagacaggcagctaatctgagcacttaaatttcactgaagatacaatcttaagaataagtttgtccagaccttagcttgtctcggagatagaactgcatgcatttggatggaaacaaaataaatatttttgggctgggcactgtggttcacacgtatgatcccagcactttggaaggcaaaggcagatggaccacttgaagtcaagagtttgagaccagcctgcccaacatggtgaaaccttgaccctactaaaaatccaaaaattagccgggcgtggtggtgggcgcctgtaatcccacctactcaggaggctgacacatgagaattgcttgaacctaggaggccgaggttgcagtgagccgagatcaagacactgcactccagcctgggcaacagagtaagactctgtctctctctctttatatatatatatattagcacagagcataaaatgtccaaaagctatgatcatggtcagtcaggctaactttccaggagggttggtataggtgaactgttttgctgagtggagtatgcatcttgagggcctacacctgagctactcaagcaattaagggaagactgaattctgcctttagtctctcaattctttttgtttatttcgatgtgtacttttttaatcatttatgttattttctattttcttaagcagatctgatattttaggatagctttcaatttacagaaaagttgagaggataccacagcaagtttctatactctgtattcagtttcccctattattaaccttgtatattagtagggcacaattctgaaactaacaaactaataagaatgcattattatccataaaatcccacatgttggcattctcacaattgctattgtttattctgattttttgagtgttcacctgattgctgcctgtgttctaatcccaggtaccgcattacatctaatattcatgtctccttaggttccccttacctgtgacagtttgttgattttttctttttatgatgaccatgacagttttgatcagtactggtaaagaattttggaggatgcccctttattggaatttgattcttttcttatgattacatggggtttactggttttctgtagaaatttttaaagtgccatttttattatgtcatatcaagatacacgctacaatatgatttattattattgaagtttaccttatcatctgtctgaggtaatatttgccaagcttctccactgtaaagttacccttttcttctctctccttttgcatagaatactctttggaaggaagtgattatgcatagcccactcttaaggagtggggagttacggtcttctttccttatggttaagtatctacataagttatttgggattctatcacaaaggggttgtctcttctctcccatttacttatttattccatcatatatttttatcagtataaataaactcatggatactattttatactttgatttgtaatctaagtagtaaatactatgttacgttctcatcagttttttctggctttggccattgataggtctttcagctggcttatgtcattttaacattatgtatcaattcactgtaagttttcagggtttttttttgttgttgagcactacaagacactccttgcttatgttgtacattttctgccttggttctagaatcagccatttctccatggaaatagctagtttctttctttgcagaatttcattggagactgagatttggaagctaggtgtgtatgttattgttgctacagggatgtcttttcttggccttctcaacagacagatcaaagattttatatatatatatatgtatatttttaaataatagatatattaaatatgtctacttaagacatatttaaataatacatatattaaaagatatatttatatattgaaggttgcatatagactaacacatatctaaatttttctatgtaagcatctgtatctgtattctgctaaacatgtgtctacattgatgtctacccccaaatctaatccataactacatcaataattctaccctcctcccgttgcttatttataaatttccactccaacagtgaaaaacctccttcccactgtctattattcatttacttattttttcagtgacagaatacacataaagcattctcacaatggttataccatacctttgcactgttcaactttaatggctaggcggtgcatttgggcggtagttttgcctttagtctgctgaacacttgtgaccttcagaagtgtttcttcactttttttcctctcttacgtgagacggaaaggctacagggagcaggaattggggaagtgccttctttctggtgagataaggctctggtaaaatatttttactacaggagtaggcaattgttattgagaatgctctgtgtgcatttcaaaatagttacttttccccttccactggcagagacattagatgattttttttgttgctgttggggttctttgctgtgagaacctggtgtggttcctggaggtcaaacccatggaagtatcggcattctgcctaagactacagaccccaactctcgttctagtgcccatacagattccagcaacttgtccaaattacttcttaaacattcctaccaatttatggttccagcagattcagttgcagaaaagctgatcttagccattattctctgtattcacctgtttctccagatttaaggtggcagtgtgcccttcaacctcaattatccaatgaatacaagaagacattttcagtttgttcatttatttttcttattgctaggacaggaatagcgacttccaaactcttagcttgtcaaaactgaaaccacagaagctatctgaattcatgttcaacaaaaatgtatggaatataatttggaagttggtcaaattattagactcttatcatgcttccacaagtttcaagcaacctccggataggaataccagcaatttaaacttgaatttcaggtacaagtagtcactgaaacaaaatgctgtgagagaaagaaaaaaagttctaaaataataaattctggaaacacatttatattaatggaccaaaataatacaaataaaaacaactgtttaatatcgcaataattcaaacatatgaaataacagatttaggaaatatctatcatgaacactatgaataaacagaacaggttaagaggttaattctgtttatgagtgttatccggaattttggacaaggccctctatctctcagattctaagcagagactatgaactaatggtacaaaagatgaattaggctttttgacaaggaaggaagggaggaagggaggcagggagggagggaggcagggagggaggaagggaattactgacttttagtgatttggcagtttctctaaaagatctgcatgctccagaaatagttggctgatattgtcccctggcagcccgtattagtccattttcacacgctgataaagacctacccaagactggatgatttatgaagaaaaagaggtttaatggactcacagtttcatatggctggtgaggcctcataatcatggtggaaggtggaaagcacgtcttacgtggcagcagacacaagagaagagagagccaagtgaaaggttttcccttataaaactatcagatctcatgagacttattcactaccatgagaacagtatggaggaaactgccgccatgattcaattatctcccaccaggtccctcccacaacacgtgggagttatgggagctacaattcaagatgcaatttgggtggggacacagccaaaccatatcacagctctctgcagttgctgaacatacttgctttcttcagtttgtcatggatttgcccagagcatctcacttgtttttgtagctgggccttctaggcacctaggtttttcttgtaaaccagtttattagataaaaaaagatatgtcttttatatccctcatatgtcttttatagacctgaaagtcagacagatattcaggatatcatcgcactttaataaacatgtccattcatctgactttttccatgggtactttgcaatacacaatcaataatgaagcacacatagaggtatttccattatgtattggatctttgttatttgaggttgttgaaaacaatcaccttttccaaattatctctgtaccttctctttgttctctgtcattttcctccattttgcaaaaagactgaccagcctttataggtccactgtgaaaaattcggattctggttcaagacatggtcattactgccactatgtggcttgttttggaagttattgaaaataaaacatttaattggagcttttgaacttaaagctgcaaaaccttgatatgttccctagtctccatagcttatactcatggatatactttttcccaagcataacacctaattagatagttaataatttcttttaacttaaaaatctgcctcctaagtaattgcgtgagaaacacacacatgcaaatgcacacagaaaaatatatgtacatacaaaatctgtatatatataaacaccaggctaattatgtgtatataaacataaatatatacacaatctatttatatctattaattgcaccttccttatttacacaaatggatttatatgcatacgcttttgcgccttttattcttttcaatggctgtgtagtattcatttatggacatttctattgttttgagtttttttcacttttgtgtttatttccgtttcgttatggacaattgtgctgctgatgtaccctggaaattattattttgaacttttgcaattatggaaatttgcatgatagaaattctaaaagtaatattttggatcaaagagtatgtatatctaaaattttgaaacatattgtcaatttgctcttcaagttagcaccacggctacttttccagggccttttcctttatcagatattcttgaaatttaaatttctctatttattttaaaggcagagtcttgttatgttgcccagcctggagtgcaatagctaatcacatagcacactacagtctctaactcctgggctcaaatgaccctcccacctccacttcccaagtagctgggactacagctgtgcaccactgcacttagcttaatttcctctattctgattaccacctctttataatgagtgcagttgcactctttgccatatgtatgttgcctgtctttatttttctgtgaaattcttgttcacctgttgcctttcatttttttccagttgatttctgcctttatatcttaagaatagtctttaacataagaatagcctatgtttccccaggcttttacttatattttgatttactaataatcatttttgttacttaagacatttaaattagtagtaaatcaaattttacatatttttttctttatggtctctaggtgttttgtcctggtaacaaatgtctttctcccataaggttaggaatacatctcccatatagttttataaaggtttttgaatgtatttccattatccaaagagttcattcatatcttcttgtgttagtctgtttgccttgttataaagcaatgctgaggctggttaatttataaagaggtttatttggctcacagttctgtaggctgtacaagaagcatggtgccaacatctgcttctggtgagcatttcaggaggcttctgctcatggcggaagggaaaggggagcaggtgtcacatggtgagagagaaaaaagagaaaggcgaagggtgccatgctcttttaaataactagttcttccatgaattaatagaatgagaactcactcattactgcagggaggatacaaaccattcatgaagaatcaacccccatgacccagacacctcccaccaggcctcatctccaaaattggggatgaaatttcaacacgagattcaaaggggacaaatatccaaactatatcacttctctttatcaaaatctaaaaatataaattgaactaaaattatactttactgttatccatagttatgttccttgccacaattcataggtaattaagttatgacaatgttaatggtttataattttcgtgactagttgagaaagccgttcttttttttttttttttttgatacagagttttactctcttacccaggctggagtacagtggcaccatctcggctcactgcaacctcaatctcccgggttcaagctattctcctgcctcagcctcctgagtagctgggattacaggcgcatgccaccatgcccagctaatttttgtacttttagtagagacagggtttcaccatgtttgccaggctggtctcaaacttctgacctcaggtgatctgcctgcctcagcttcccaaaattctgggattacagtcgtgagccaccgtgcctagcctgagaaagcctttcatagtgaagctttgttgttaggtagataaaaatttatgaatatttatcacttggtagattgctcattctatgaatatgaaatatccatctttcttccttttaaaatgcattttatacataattatattttatttgaaattattactgttaaaagctttttcacctgtacattgcagggtatatctttaccaattctgtcgacttttttctctgttgtttttaaattagctctttcagaacatagaagaccagatattcagtgtatgaatctgtcttttaatagttaaatctaaccatccacagtttttatcatcactgatagtttcacacttattcctgtcacatttatttccaatttaccatgctctcttgttacaaacccccttattaatttttgttgaattaatattagtttagttttttcatgtattgtatattacacaattcttatattctagtgctgtctaatttctaatacttaaatatatatattttgttcatcagtgtctaaaattaatcagcatgcatatattacattgtctttattctcaacaatcccagctaggattttttgtttttaaatgttcattcttctctctttttatgttctttttcttatcaatatcttccagccatgttgaaattctttggactttactttcaagcattaattttaaagccgacattttaagaaagagcttacaataaaatatcttccactccttcctcctggattcatttttcttcggttagaactatttctttctccatttcttacttcataagtcatctttagaatctatgtaaatataagactacaagcagccactaccaattgattagaaatggtacttagggtggaatttatctttagttttttatagttcagagataacatttctaaaaggctaggaaacatcttagagtatcatcttaattattgtatctaccttctttttacctggatcaagtgcattaagtattgtctgtgaattttttcaacaaccctataagagagattttattatctcaccatatagatgtgagattcaaaaaggttgattaacttgattttttttatcagtgcttctaatactggcttctttgcttttgaaatgagaaaaaaaaaggtatactgagttttagagttttacagttactcaggttaacacttaaaatctgtagcttgacacattgggtactgaatatccagattcaaaactctcttttattttgattagcatccttaaacttctatttctaaagaaagtcttcacctggagtttctagaagagaactcttctaccttttgccacctgttccagcgcccagtgtgcagggagtgttaaagttgacaacttattggctcttgagatgccatgtgatatttcttttggggtaaaatttttctgaagttgtcatctacataagccttctttaggcttctatatcttataagctattatagtcaaaggagaaaccaagagttctgaactataaggagtgaaatgctcacaaattctcttgttaaacatggtaactacctggtaacaagctgaaagagaaaaacagtggaatgtggtggccagatattctgaaccaatgtctttcatcattctcagaatgttatgaaatttaataagtgttgattcaatccttattattagtaacccagctagtaattcaatttttttggtaagatgtacatcaactaaaacatacttgtaagtgccttttggctgtcagtcatagtgtgccatgggtgtgcattaattaaaatgagatagcaggcttgggatgctgacatgaagaaccctcttcaatggatcctgactaggcacagagatggttggggcaggggaggtgaatactcaatgtattggaaacaggacacaaattatgtcttatctcctgctcctctagtcaggtgaccaggaggaactggcattccagtaacttctcaatgcttagctctggtgttataggccctccataatgtatccttcgtctcaactctgtacgtgtgatttcccacagtattcaaaggtggaaaggcatcctgtgactgcattggagaaaatgatggagtcaagttttgtcggcccccagtcattccctgaggtcccttctcctgacagaggaagccagtctgtcaaacaccacaggtacaagtagctcatcatggtgggtgtgggcaccttcacactgtgtgtatgctgggtggcacatgccaaggactggcagcatgacttaggagagacaactgttcttgcttctcctgtagttctctgtggagtaaatgctcaaacacctcacatcaggtaaagcaaagataccagtttccacagcagacagcattgcctctgtaagaaacctgatagaactatagataacacccatcaaagttacagaccagtaaaaaaaaaaaatgcattctgaaaaactattttaaaaaatatgttatctagcctgccttttctagattacacagttaatgagtaattcttccctatgcagcctaatgtgacagacttcaggttttccaatatggttcttacaaaataaaattttccacggggaagaagcctggtgaatcttcttcttgggtctataaaatcttctgttataaatgaggtggcagtttcttgcaagcttcccagaaattggctgctttggagaaaaagccaaaaacatagttatttgacacatttcatagcattctaaagcttaacttgtccttcagcatcttctagtccacacttttctgttatcaggattctgaaactccaaatattaaaggtatttgttctaaaccaaatgatgaagtttatgactaatgctagattgtgttcagatatacatcctcaatctttatggaagttgtccgaagacttaagcttccttttcttagtgaaatgtacaatattttacaatttgaaaaaattatgaaaaattaaacattttaacaatgaaaaagtaaataacagttgttcccagcaatgaaagttgaatgttgttgcccctttgttttcacatgctgggcaatagtttgcacaacaccaagccagaaacatacatgatagaagaaaactactttctccttcaccttttaatgagttacatgaagaggattttattgtttctggccacacttactttgagatttttagtcactcttgacactaatcctcagcacttcatggtaatttttattctcattctacatgagtagagactagaacactgagagtttgccatttaaaagaatatggtatgagtctatgttcaattcaggattgaaatatgtttggctcttggataattgctttagctattcttactgcaagttttgatttatatcaatgttgcatttacagaatattttcctgtgaaaagagcatttcatttcactggacctaatggaagttttcttaattagggaaataagtccaatattaccagtcttttcgaagacagatattttctcccaaatggtattttctcctcctgattatgacacgttaaagtagtattccacctagtcaagtaattcagtataatatcattctagtattatatgaactgtattctgtcataaatgttttaaaattgatatatatgttttaaaacatcagctcttaatatgtttgagctgcaatattcctatccccagttctcgtgtgcttttatgctccctcctaaacttggcttctcctatggtgtctaggagtcactcacagattaaataaggacatctttaagagaccttcctttttgtttggatcaatgacattgcagtatctgttggcatacactgtgtcctgatagatgggcaagcgttgacttacaaaatgcttttagaactttgtaaattatagtttaatatatcatagcttttgttttgtaaaacatgcaatagacttgaacgttttcatgatcgataacccaggcactgatttatatatcctgcaaactgcaccataacttcctgaatgccactgagttagaaggcctgaatagctgattgatcaataggcataaaactctttttaagacaggtcactagttcatactgatatactttgttgttatgacagtttagcgaactatgaataattaatttcttttgtgcactgcaaatatgactcatttggataactcatatatgaaacagagctattaattcaaagccattatttctaatgtttagttcgaaaaaatcccatctgtttagaaaataaatctattacggcatgtcatatttattgcattatattttggcaatataagtcacttatctttttttattattttatttttttggagatagagtctcgctctgtcacccaggctggagtgcagtggtgtgatcttggctcactgcaacctccagctcctgagttcaagggattctcttgcctcagccgtctgagtagctgggactacaggcacatgctaccatgccgggctaatttttatatttttagtagagacggggtttcaccatgttggccaggctggtcttgaagtcctgacctcaggtgatccgcccgcctcagcctccgaaagtgctgggattacaggtgtgagccactgtgccccaccatgccacttataaaaagcatgtatgtaggttttttgcattgaaataattccagggttttcagtgacagagaggaccctttgaattgccagctgtggcaggggagatagaggaactcatcgtgctgagcacctattgtgtgccaggctccatgccccatgctttgcatacttcctctctttaaacctccacatcccatagtgaacctaggaaaattcttaagtagaatgctgatatcttccttttgtcactcccttctcactctagcagctagtttctaccttttttgttttctgccttgccctgtacaccaagagggctgcaggctcttatgtcctctggtttctgtgggttcagtgtaaggcacaggcatgagatagacggcagggaggacagtgaggtcatggcacttgtgtccccttcctccctgcttggttgccttccttatatcccttttctggggccatggagcctgcagtgcggccccctccttacaactcactttctctctgcattctgggaactgctccctctccttgtcccttaagtcagagggataataacagcttcccatagtagtcctggggcacagcagtctcatttattgctttttttgccctcgaacacttatcacacttttgtatatagcaaaatctctaacaatgaaccaggttaaagtgccatctatgtctctccaggactctgactggtacaagtacctccatcagcatcatgcttccagtaactagttacctgcagacctgagacttatactcagttgcagccaactctagcatccaaggcttcaggccccgcagaccccatcattgccattggatggtagataaaagtaggaaggcaaggaagcaaattagctgttagagagcttctccaacttgtgggcttagtgagctatctagacatcccttgttaggcatttggggacacaccatataatgaatgaaggtataggggctaggcacagtggctcaaacctgtaatcccagcactttgggaggcctaggtgggtggatcacctgaggtcaggagtttgagaccagcctggccaacatggtgaaacctcatctctactaaaaatacaaaaattagcctgccattgtggggggcacctgtagtcccagctacttgggaggctggggcaggcgaatcacttgaacctgggaggtagaggttgcagtgagccaagatcgtgccactgcacttcagcctgggtgactctgtctcaaaaaaaaaaaaaaaaaaaggaatgaaaggaatgaaggtataacaatgaatgttgccagatatgatctcctgcttgcacacatttaggaagttaatgttggcttgaggaatataaagtttgatcagtcaccgtgccacaaccaagaaagtggttactaacactcaaataccagattttcaaactctaaccttaaataatatttgtaaagtcctgttttgtattgactaagtagaattaacagtaatatttatggaagaaaagtgacataaccccaaataatatagtaatatgggtaaaatgtctttgagagactggtttctttagaaccttgataaatttattgaaattttgagaatgttttcatctttctttctatggttgtattgatatttacagagttaaatgagaatggagcacagaattctcagttcctttattatttgagcactgcagaaccagtgtgaccacataaactagcatctcgtggaatgtctacacatgagcaaagttctcctcaccagtctacagtagggtcaattcagtggggtggagatgggaatggatatggaacaggtaatgagtctcatcagcaatggatttttatagagtctagttcttttctgtgcataatctatgtaggaattctcagtttgttaaggcctgtggtataacccacttacatgttttgctcattgatggcatctataaacatatagttatttaggcatttggatgtatgagtcaaataaaatatataatcagatgtttattaaaagcaaactcagaagaaaaataatttagtttgtcaagattgattaaaatctgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaacttccctttttctcagtgtctccaaaggtaaaatggattgggctattcctgatctcattctaccacatatacttcattcagggatggccctggcctagaactttgagaatttggggtgcagattcagtgtttgcaaagcttgagcagccacctgtgaggttattgctatgatgtcttttgtttgtttgtttgtctgttttcattccaccccagcaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtaggtcttaaaacagcagtggaatttagggagggtgtctttaatgccatagctttaagttaagttttaagttccttggggttttattcattgatttattcattaactggctatatatgcttactgccatctttgttctacaaaaggtgaaccaactttgatgtatagttgtgatggaaaataggtatcagggaaacattagattagaaagaaatataactaggaagaaagtaagtgtagctctctaggcaatatgttattagatcatttgctaatacaactggaaatttgtctttgatttaaaaaatcaaaggaggattaaagtgttccttcatctgcagattagaaaaaggaccgaattctctgataagtattgtgaacaatacgctaaacaataactcatggcatacgtacagtatctgcttcccctgagcttgaatgtagaatttgggtcaatgttgagagtgtaaagtcaaagtacaacttactgaactcatatatgcaagttaggggtagacgggtgggctttggacaccattgctgctactctttacagtgcaaaaggtgtcccttcctctggtggacacagatccatagaggcctcaaagcatggtgagctgagtacaggatgaatgttaaccattatccatgtagttggcataaactgcccaactaaacatgcgatccttgcttaaactgactggaattcaaatcccatctctgctccttactactagtgtgactgtgataatattttatgatgtggtcttagatgctcttatctataaattgagaaaaatagaccagacgcactgcctcacacccatagtcccagcactttgggaggctgaggcatgcagatcacttgagctcaggagtttgagaccagcctgggcaacatggcaaaaccccatctctaacaaaaatacaaaaaattagctgggcatggtagtgtgtgcctgtggtcccagctgcttgggaggctgaggtggcaggatcctttgagcctcagaggtggaggctatactgagtgcacatggtgctactggactccaacctgggtgacagagtgagaccctatctcaaaaaagaaaaaaaaaaatacaaataattgagtaaaataatatcaaccccctgaagattgttgggcagatttttaaaaattatgtgtgtaaagagtttgtagtagacacacagtaagcagagaagtggtactggtatttattgtcacagtaattgttataattttttcagcaatttcaagtgcaatgcaatcagggtttactctagaaatttcagaaatcacttccctcactcaagccaggttcttgtggctctgtttttatctctctgaacgagccaagccaggtttctatgctgctttggcctggatgatttttccagactgtctctatcaggctaaagatcaaaacgggttacgtctagcacagagcctcacgtttctcttttcatatgggcatgggatatatggagcagtgtcctgtctaacaaagatcagcaacagatttcttaaggaaaactggaagataggaaataaatggccggtggctaggttttataattttgaagcaattccaaatggactgtaaaaggcatttggtacagatttagggtgacagttgcaaagtaaacataacagccaaggggttcaaaatgtataatgcgagtcaagaagcagtttgcatttctcttggtcttatctgtggaaaagcaggcttgcatttaacccataattataattgatcatgtttcatagtgccttttccatataaataactaatgatgcctcttattagtgaatatgactatatacatatacataaactccctgggatgaatgttacaagaacaagtgagggaaaatcaacttcagagattttgtgagtggacaaaaaacccagctcatgctggccttttttttctattgggcactgttatgaccatctttccatatgttcgattagtaagggtgcttggagcctgtgccaggctcaagcttgaacaatgcacatatcatcaggggctcagagatctcattacatgttcaggcaatgctttgcttttttaacctcctgggagactcacttattttctgcgtggtggtggttttgttttggttcagtcactgttgggttggaatattctctccagttgcctggccacaggtattttcccatgtgtgatatccaccagatgttgataaatggtgactctaaatataagtcactgtatacccagcacaatgaatctcagggagcaatctcattctcagttcttaaaaacagccattttccactccctggggactgactgtctctctggactggaaatgggattcgtaatagaatttcacagctaaaggccgtctttaaatctggccccagcctggaggagggggaaatgaatttgcaagagccatcagccatctgctccttgtttaccaagcaagtgggcgctgtctatgacagttaggcttccaacgtatgtggcttctttccttggcaagaacttcagcccagcttgaacctaacatcgatcttattgtagcctggggaaggagtgaggtggagaggagattcttgaggaaactttgtcatgactggatccctggtcaatgacagccatggtaatggctcacagaatttgaactgtatcatgtcaggaaaatcaagctaatgtattcatatgccagacaaaaagagatggaatcacaaaagttagattcacaccttaaaagcagataaaattcaaaatgtactgaatacctaccacacctagctagcaactttatatacttctcttcagttattctttagaaattttattgataagcacattaaggatatcagagtttaaatggctagcccaaagtgacatacacagtcctgtgtaaaagagctgcgattgaatactggcttttctgactaaataaaccactaaatcaacaaggaatgtgaagaaaaatcacatttatggctgatgatttgtaaacggaatatctaattttatggcttcagagggaagcgtggatgccttcaaaatagtctgttcattcattttcatgtgccctaggaactgagatggtttggagtcgcctagagaaacacaaattccttagcctgactcatgaatgactgggaaccaaaccaagtgactaatagttggaatctttcttctttaaaagaatgcttcgactcacatagttacagacaagatgcatttgtaatttctttgttgaggatgagaggaagactggcccaaagtgaaatgataagctcatggaccgaacttgtggaagcatcattggccctcaagagatacagaactttgaatcctctgactcagaatcacatctagaaatttagctctcacttaaacttctgctggaataccagtggtgagacactcacatcatgtctggggggaagtgaggcttgccactgtgtctctggtagaacagggcagagacattatttcaattagtcctcagaaaaatttcccctccctctgagcaatcaagttagtgttactacctgattgttttaattgatggcaaaattaaagtgaggctgccatttgtctgagattccagagcatatagtaattttggaacttgaaatcatgtctaattcaaaacaaaatcacagttaggaaagttctcattgtttacagctcatcttcatgtcatggtaacattttaaatttcagttgttaccagtcatgtgttcaaagcctgacttgggaattgacatctaatagtccactgcaattcctctttctcatctaaatcctttagtcagtcctctggcatatgagaagaaccctcaaagtttggcgtgaattgcctttgattatgtcttagtcatgccacatagttgacttgttgaatttatattctctaagatatttgcacctttttccaactgtttagacccaagtgtaagaatttttacctgtcaccatcacatatcaacttaccagattctacctgctggtataccctgatgatatttgtgggaaatgctatcctggctacattttttgtctctgtttcactggtgaacctgacaggcagactttctatattttcatacatacaaatcatgctaacaagatggtgctgagagcgaaacaaaagcctgaaattttttctttacttcttgttgaaattgatttattgattagaacttttaggctcatatttttagctcatatattttaggctcatatttctcatataacactaatgagaatggagtaatattccccaagaatttccaaatatgtagctgtgcagtttgtatgaataaagattacataaccccaaaaagcttttctggttccccttaggatagtcgttcattagcaacctctaacattgatagtaattagaataagacaacttgggtttaaattctctgtgtgacacatactaaagatataattttgggaaagtcatttgagtacctcttagtctattttacgcacccattaaatgataataataaataaactacaaggttttttaaaaataaaatgagttaattggagttgaaagtgatttttacaagcactgtacagatgttagctgttgttattaagtctgaaaatagacattaagtaggatataaagggagagtttaccttgaagatttgtttatgtattcatgtgttcactcagttcaagtgtattgattacaaactctgtattaggcacagtaagagaggatgagcctacaaaggcctaaatctcttccctgtttgtgttcactgtctggtggaaagacctctaatttgctcccatcatgtccttacaataaagatttgtatttagtgtgcaacacactgcattgcaattattatctacatgtataaacatgattttcatttacataataatggcagtcgaggaaaggagatttattgtatggaaggttgatatgtttaaattgtgtcaaaatttgaatgtttactgtttaaattagggacaaataactaagaaatagaataaaacactactgttcaagttccaaaaccccatttctataaatctgctgcgtacctgtcccattttctgtcatggaacagcacagaggagacagatttactagccctgcacaggcaagaagggaacttagaagattctgctatattcaaatgacttgtgatggcatattggcattcttgacaagcccttgccatggaccaaagaactaccttacttggtttcttggttacttggttgtaaggaaagatgctagatgggtagaagccctgtggaacccacttcatattcatccccaggcaggtagaggaattgttagcctcccattcccaccggctggctcagcaatctggcagtgaggtggttcctttagagcacagtgccagtggaaattggatttggatcccctaaaatcagtgtgaagcagaaaaactcttgattgtagtacctggatgcttaatattgggcttcttgattggcttcgactagggtggccacaacaagtctactggactaacccagggctgagagggtggtcgagttgatggagtggactaatgccattatgggtgtcctgtttgtcacaatggaaaggccacacttacctgctcaatccccatttactttgtattctaggatagaggtcaggaagactatatcccacctgcctatacagctgtggtgtgttgaaagacccctggacttaaagtaagaagatctgggtttgagtctcagtctgtcacttattttctgtgtgaccttgggcaagtcacttcacctatctgagcttcagtttacttctctgtttaactgggaacctattatccgtctcatggggttgctgtgagaattcagtgagatggtgcatgtgaaaagtgctttgtggattgagtattgctctaacaaagcctggtagaaagcagaaggagtaacactgtgtttctttttcaggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagcat

SEQ ID NO: 2101 - DNA, 1111867 bp, Homo sapiens; identical to SEQ ID NO: 2100

SEQ ID NO: 2102 - DNA, 1109494 bp, Homo sapiens
acaggaaggagggaaggaaggaatctgccacaaaccagaatggcagtagagccagtaacttgctgcttctctctcctttggctgaagcagtcatttttgagagcacattttcccaggaggtgtttagagcctccactcaacaaatctagcttgtgttttgtagaaggataaaggattcatgagtgtatgtgtgaacatattcaatggattgaaaatgagtctaccctgaagaccccagatttttgatctgctcttttgatgcagttgatagaataatggagtgtggtatacctccaacccttgtatgcgttgggagaggagggggactacacacggtaggggtatttcatgttctttctcaattgatttccttgtgtaccattccggaggtctttaaagaaaagcccaaggtaattatttctacccctctatgctctcttcctacattccgtggacgggaatggcagcctgtttaataagtaatgattattgacagggccctcagccccaaggaaaagaggggaaaaatctgtaaatggtgtcaatgttcacatagacatataagcagtatttgttgtatttgtatcttagtttcagctctttctcttttttaaacctttacaagaagttgaattaaggtatgtaatacaagtatgcaaaatccagctgaaattgacctggtttgcatctataaacaagggaaattttaaggaaaagtggattatgtagttttcataaaacgtgtttaaataggcaagttgtatggtgacttgaagaaagaggatagtttagttatttttttcatccaagattgcaggatgattaacaaaaggaaattaagatttcatttgagagattatcagcagtgctactgtaggatgaaaaaagcctgaatcactggtgttcatattttttttacttgtcttgattatgcccgtaaagttcccaggagagaaattttcttttccccagctcctacctccatactttagtgggtctttccgtcctttcttttttttaaatgaaagtaatggattctgttgtagtacttgaaaaaaggttaaggatgatgctttcgttttttgactaacccacaaattctttaatggccaggatctttgctcttgcattggatacctgaaggcttatggaatgaatgtctttgtgttcatcttagatcaatcagaaggatcctgtctgtaaggatcctgtctctttggagtggaagaggctggttcactgacaatgaacatgcttgctaatggataataggattttttcaagcaaaagctgtttttgctatgggaaaggcccagttagagaactgtttctaattttctgtaggaataaagacaaagaaggattgaactttaaaggcaggaggagaaaggagggtttgcaagttgattcttctcttcccgtcctccaccgtttaggccgtgagctggaccaaaactttcttcagcgttcctgggattcttgggtttccacttgcctagtacttgcttgcacttcagactctaaaaacgaatgtcttaaacatatcgccaggggagattatttcaccagaaacatctttgaagcattttgtatttgaaagtagaggttaatttacaagtttttcaagccaaagggaggaggtcactacagacagtagaaaacagtgattttgaccaatgtacaatcagcctttcccttttacagcgccttcaatttcgttttcagatttgaaatatagttgtacaatgctgccaatgcaaatgtggattgttttagagacatagaattcttttactaagctgaaaatactgtttaacaggtggtagcccggagtcattggctaaattcaaatactaaagacaaagagcctctttttataggtgtttctttgggttagatttggaaggtatatggttaattataatgaacatcacaaatatctaatagtgtatttaagaagaaataaatgtagaatgtacatttgatgtttaagcaaggtatggaggcaattttaatttaatcatgtctatttctataaaactttacctagtcatacctactgtaatttttaagagaggcattgataaaatcaagtattttcttatttattcttttcaacatcttcattccttaaataagggtacacttgtttgctttataagcagcctcagatataatttgtttaaataaagttacttctgtacattgtattctctctacatgagtcgaggcctttaaaggcatccaacgtagaaggtactgaccccaatcatgcatggtagccaaagtgagaggattcagagctcaggatcaatatttcttatgaaatccaattgagagcttttttttatgagcacaggctgcaacctgagtatgttttgatttcctttggccttaattcaggattatgagacttttctgctttaatcaattatgctgtacaattttactgttacacacttatgttgcacttcatggtcctaattaaaaaaagagggcaggggtgggtgtgttggcaaggatatttttagggccctttttagtttggactcgttggtctccgtgcattaagacaatgcggtttaagcattcctccccagttcttcagactgaagtgagggataggaggtgttgttaattgagagtcccttctgcaggattaatttgtgaatccagctacagttatatttgtgctattttcaaaacctgaccaaaaaaaacaaaaaaaaacccagctggtttctggcaatttctcgctgttactgaagcttttctaaattcaggttgggcaacaacaggagtgttggtgcagtttgaaatcagtgccttcctgggagatccaggatgtagaggaataccatctctcctctctctggagctactttctcagcccttcctcccctttgtacacaatgagaagaaagcttattttcaacttgcttttgtagaaattctttcctcataacctctcatctccaatgccaaacatatctcaatattctatctgggatgtcaaaaatggaacatgaaagttggccctgaagtatataagagcaagggaatagtcataaatctaagtctgtaaaatgcatttgaattgcttctgaatagaactgaaattcatttttctttctttctagctgtttttatctttagactcgtgtgttgggtaaggacagagctggtactgcgttgacaaatacattttgagatcctagaaattttacttatccacccaagaaagtgttccctccagaaccatatacataatgaagtgagcaatggactctatttgaaactttgcaatatcacaatcaaaacttacctacataaatgtttcctcttcatgcaattataaataaaatcattagacacatgtttagtttggttttccatttcactcttcccctaagacttcctgtactcccacctgccagtattttatagttgaatcatggctctgactgaaggctcctttcaggcttttgtgttttttttgtgttttttttttttgtttttttgcccttttttccttagcctagagtacaaggagtcaatactcattaaatgaaatttcttagatatgcttaacgtcttgcttcaagttgttttataagttaatcttttgggtaagttagagtgcttaagttgatgtagaaagttaaggaaaaaaatactcctttagggaactgagttattaaactgtcttggtgatttaaaacaataattaaggattcttaaaacctgatggaagctaatggtcatttcttttcccccatagattggtatacaaatcatattaattttggtagcatttttatctgattccacaacacagttgagcaattgaacataagctatcatatacattcatataattatattttcataatatatgtcacatgtttcaaatgtttactaagtatctatctgggggcattgcaatgctgttaagtaattggttgactccgaaagtttgtaaaagtaatggttcataaagcagacaattaaaataaaacttttaatcactacaacattcagcctcccatgtcttgatgttagggcgaaggctttttctaagtatgtgtctactggtttaagcttagcatctttgcttttcttttttttttaattagccacacctgtaactatcagctttttttttcttttaaaagacactagcgaaggaatccgtatgcagattctttataaatacaataataaacccttgccctgggaatctcttgcagttttcttgtctatatgattcagtttctttttttatgctttaaaaaacaacttaccttttggagtttcttcaaagcattcaactacattttaatagaaactacaattatctttcatttccataatcatatatcactggtttacataatatttaagtaaattacataattagcataagaacaactgacgtaaacaaatctattatcccaactgagtactgtaaagtgcacaactcagctggcagttgcagcagagtgtaggtttccttgagcttggcctggtggctgtgtccctttcactgtgcagtgggcctctttggtgtgttcctgccaggcagtgtggtggcagccagttggctaagaggagttagattaaggaagtgattcctttaggaggtaacagtattagaaatgagagtcagtcataaccatattttttagggactctcatggaagggtaacaaatatatgtgtgtgtgtgtgtctgtgtatgatacatatatatatttataaacaatatttgtttgtatatttctatataaaacctctagccgtgaattctataatagctgtgcaacctttaggaactgatacaatctctctgaagtttaacttcctcccctggtataatgaggttgatgacaataacctgacttctatgccaatcccgaaagagtttataagctgaaaaacaatcactgtttttatgtcaagtgaaatgggaagtagatagactggttattttcatccaagagcacatcagactattgaattcggttgaaatattggagctggtttgttacctagcttgagggatctttcatcacaatgaaagattattgttcttatatgcccttgggtttttcttatattcctctctgatatcctggcacacacaataaaatatagtgtggagtcctacctcaaatcaccttggaagttgaaccacaaactggaggtcatcatttctcattctttgcttggaaggtgttttttaaagcctatttccagcatatgtttatcaaagagaggagctgaaatttgggagaaaatgagtgagattcctgaatgatctggaaatctgaaatctaaacattcttgataaagcaaaatatgtcctaggtgcccttttgtgccatccctacactaattgtcattgggtctttagattttggagagaatttgtgtgaaaataggcatgtctgcactgcattcccttggccacttagcagttactgtgaattagattctcaagaattaataggttgattgtatccatcaaggagctcttttaaagatactgtttggatttgtactttggggaactttaatattagcattttggaaatatatttcttcaaatctgtgtttgttggaaatctcatcctgaattatatcttaaagtattactttttgttgttataagcttttatttctcaagacaggttggtgattgtacataaatcatagattgccattcctgggcctaaaaagggatcagtcagaagcaaacctacaaactgaattcagaattaagtttaataatggaagtttagcagcttccagtgctaagattttgtctttgaggccttttcctggaagtgatagtgtgtatcatggatgcaatataggccatacgaacatttttttaaagaaaaggtcagctgaatccatgcaactactttagcattagtatgttacagccagggttatgggaatagaatttttatgctaaacgtttgataagaattcttaaatatatcagccttcctcctcagataccttcctatgactacatgcaacctctggcatgatttcctgtgaattgccagggagctagaaatccactaaaagagaaagccacaccctcatcatcatcagattttcttcatttttgtagcttgaattttacttttagtaatgtagaaggattagtcacagataatcagtcttggaaggggcttaagaatttaagtaataataaaaacgacagctgccatatgtggagggttaccgtgtgcctgggcatgtagcactgtacattcttcgtgttatttatttttgaaataaggattgaaaaacaatcatatctaggcctgcagcctaggtttgattatctcactgatagagttaatcaagctgggcttaggatatataatttgcctaggacttgcagaaattgtttggataatcaagaagactggaggagtgttttacaggtaatctctccccacctcagtcttacttacctaattcactgttatagtgtcactatatccatttgtacattgcttctgtcaagcacttcacacacagatagtggcatttgccactgtaaactccataaatagctcacctgcactgtacctgttctttgctctgatatggaggaatctaactagagaaattgcctgggttttctgtctaaggagaaattcagatgtttcggtaaaagataaagaatatgttgttctgaatgttgtcttcttgtttattttttaagttttgttgatatgtaattgatatgcaatgtgctctccatacacatccttgggttctgcatctgtggatttaagcaaccagggatcaaaaatatatttaaaaataaaaacaacaacacaacaattaaaaatacaaataagaaacaagtatagtataacaactatttacatagcatttacactgcttgtaagttctctagtgatgactgaaactatatgggaggctatccttaggttatatgcaaataccaggccattttatgtaaaagacatgggcatcctaggattttgatatcctgggggagaggaatcctggaactattcccccctggaataccaaaggatgactgtacaaaaaattgtacatatttaatgtgtacatatcgatgagtttggacatgcatatacctattaatgctgtcaccacagtcagggtactaaacatatccatcacctccaaaaatttccttgtgttctcttgtggttttaattttgtttaggtagaacatttaacatgaaatctatcttcttttttaagtatgcagtattatattgttaactaagtactatgttgtacaacggatctctagaacttattcctcttgcataactaaatctttgtacccattgagcaacagttccctacctctaaacttctgttccttgatctttttaactctctattttctcttatggctgcttgtaggtgattcaatgtaacaatgacagaaaacagttacagactttattcctctgcttcctaaaatccagtcaaaattgccttctctgcccattccaagcttacttttggttacaatagtgactgcagtgtatgctgagactgatcaatggaaaagtgtcagggaacatttggaatgatagccttttagttctgtagacactaaagtactgactctaccaaatcaatgatgggagttggagctgcatgcaatgcctgctgcagaacatctgaattccatcttggagccacactgcgaagtacccatcactgattatctaccagttctaagaaggggaacattggtgagaccttgatattctgccgggggtactacaaactagacccaatcattgcttacttgcttgacatttttgtttgccaagtgttcttttagctagaagaaaaaaattctcttttggttaaagtaaaagatagttgagattgttacttttacaaacttataaaaataaaatggaaatagatcaagttctaagatcacgtgacactcatttgaatagccatgctgaaggataggaatactgtagtgtcagaaagattgtattgtcaacatcctgtaagactgtaaatgaatcccataaactaacaatgacagttgtgctcattgttagtctatgaggggggccactggggttgtttgcccaaatttattgttagaccaaagcttttttcagcatggtggaaaaatctagagacaccagaattttttaaaaaatgggctgtagaaatgtttatattaaatgatagcttgactgaattctatttcattgacttttcagtatgatactctctgtttctggattaaaaaactaacacatttcgggtgtgggggaggtagagcatcaggataaatagctaatgcacgcggggcttaatacataggtgatgggttgataggtgcagcaaaccaccatggcacacgtttacctatgtaacaaatctgtacgtcctgcacatgtatcccagaacttaaataaaattaaaaaacaaaaacaaaaacttctgacaaatgcccactccatgccgagcaggtacagttggtagcacttctgtcttaaccaaatgaaagctgccttggttaacaggtattagttatattagctcccaaacctgtttatgctgattgtttttgttactgtaattgggtaatgcatttaagtattctataaatctgtgaattgtggtttctattaaaacgaagttcattacattggatataatccataaacataagtcactttaaaaaaagtgcttcttctacttgacaaagttgtgagaagtttaacgagaatatatttatatatccataagaaatttgcacttgtattgtttcacatgttaagattttattccacaataaactaaactggaaaaatcacattatacattatgggtatggtttttcataagaaggacaacagatgtttactcagagaaaagccttgagctctataaccaaatatttggcaagtgaatgtgcatttgtatgttttaagttaaaataataagtaaaataaattttgtttacccatgtgatagatattacaaagctattaaattttgttgtactaattttaaagctttcgggaaatgtttggtatataatttttatctaaaactttgggtagaaaattatataagatatccatgatattaagctttactggtcactagatttaatatatagtaactgtattcaaaggaagtataccaaattgttcatggtagttctttctggattttggaatagggatgctgtttaatttattgtacttttttgtattatctaagttttagttattgttcatgaattatctttttttctaattagaagttgttatacttttgaaaaatgtaaagaatatactccatgaatcagttcaattattggtcttggttctgtgaagattgttttttctttatgtctaaagagtttgtttcttaattggtggtgtcagcattaaaatgttgatggagttgggttgctgctgtgaaatgcagatgtgtagaagtgcaaatgcatttccatttgctcatgggaaataatgccttattgaaggcagagtttcttactctgggcctttgatgattagccttgactttataagggtatagaagatgggagtttaatgagatacttaatggctcttccagtctgcagatgttagacagtcttagtagtattgctatacaaggatatagccaacagaaatcaataagttatatacacatattaatcaactatctgatctattccaaggatcaaatgaaaagagaacacaaaggctaattgacagtgctgagtactagaaaggagatgtttggtcaaacatgaatgggtgggataaccagttcaaaggtttactggatgctataagcctctcccagaatcataagatatttattcttatattaattttcagtggctggaacatagacagactccagagtccataggagagtggtgatttgtagggcacatgacccataagtttggtgatgagttgtgctcaaagtccttcaaatagttcacaaatgcaatgttggtccaaaagagccagaacaaatatatgattctatttatatactgtgtaacaattagaagtcaagatggtgattatctttggggaggaggggcaggtagtgaatggaaggggacccaggtgtaggttttcctgtattgataatattgtgctgcttgatatgggtgctggttacatgagtgagttcacttcatcaaaatttagtaacttctatacttttgatttgtgcactttttgtatacatcaatactaacttgaaaaaataagagaaaacttcaggaacattcctttggcctttaccacttcatgcaaccagggtggtggcctgagtttataggtttttccatgtacagagactggatggtagctctgaaagtttgttgttggtgtctcacagtccagcagatgcaaagagggtcttcctggcttcagcattttcctttgttctcaggatcccctcttagtgagacttcatgcaaacacccacattcccttttgacgtaagcctttctgagtggacaccttgtatttatattcaataaaaccctatttcactcatatcaggagtgttcctgatataacacattgcgacacttttcacatatcttaacacatgtaaaaccccacttgtatcctgagaatggcattattacagttctgcaaacattaaagtgtgatatacacaagaaagataattcatcatctgcatctgtggtttttgttgagaagatcagaagatatgcaccaaagaatcattaagtgctgaaatgtgtgattccaaatgaaaagcatatgaggccatttcagaaagtagtgcttagagggagaaaggtagtttcaagggagaatttccttaggcagagtaatagagaagggaggcccagggagggaaaggtcattaataaaggtagaagtttgcatgtacccacctatatgggagccagtgagggttctgacctggtagacagacggcctcaccttttccttggagcagcgcctgattaaggagggagggttttggaggacacagcttgattctatgttaagccacagtcagaatgggttgcaaggaagtgatacaatatctgtggtattttcagaaggtgcgaggtttccaggatgacttggagagaggaatgagcagcgaattttaaagattctctaaggctaacttgttccaaatcatttaaagatattgtctctgatttgtgctggatatatttaagtattgacttcattccaatgcctcttcaaagcgctgcaagaagcaatagaattggcatgttttaaggatgtttagtttatccatagtcgcatcaacaaagccctagatttaacccaaaataacagctttcaaatacctaaaaatttgcaagtagagatacaagaagaataacaagaaggaactcttgatttcactgcctcacctaaattaacctcttactgtctttaggtttttcagaggcaaaaactcctttatgaattgattgccacatcacccttctggttccatctgaggtcttctttgcagaagccactcagcaccttttggaattgaatgctgacatcgcatcagattcaaaaggaatgctgctgttgattcctttctgtactcatcacatggtgaggaatatgctgggagtctgtataagatgaggctcttgcacggcctgccagagagtgcctgtcatggactggagaactgcatccgttcatttacatatcggcagctaaaattagtggagtcacccacgtttttcaccctaaagaagaaccttcagataagaatccagttcatcactctcgcctgctcaggcttacttggttgctccttgttaccagacagaggggctatagcgctgtgtaagagcaaatgttaaattagtattaatagccaatggcatctctcttctatttttcactgatcaggtaattttcactgatgtcaacatttataatacatcagctgacatatacaagtgttatttgcttggaatatttttagtttatctattttattgacttagataaagatatattttttaaagttatttgttcaggtctttttgtatttgatcagaagaggtttttgaaaggaaggcgaagctgtagatcagggttttaacaaaatgagcatcaaatccaaatctgtgtttctccttcatcactgagttttgtaagcttctaaatgaccttttgtggtaccacactgatgctcatcttgcattgtgagaggctctgagtaatttatgataaataatgaaatgctgtttcctccaatacactgcaaatggctgagtcttgtaaaagtctaaggagctctattacttctaaatgactagataacacaaaaatgttaaccctaaagagaaaaggtcaagtagaccacgtgcttgtgagccacagtccttctgcctggtgccttctgacaggctttctgcatctgaactctgcagggactggcacctgaaacattactttctagaatggcaaggaagggtttaagcctttcggctacttggattggctagaagcaatagtggtttgtttggagtggggaagggagaaacttgccgaatccatttaacatttgaaaccctaaattaatttttaaaaaaaatctgttaccagtggtaagaattttgtgatgctaggaaacaacaatttaagtattttatttgagcactgatataaaaagaaatattaaaaagcaagcagagtaatgttaatctgtaggaaactatagaaagctgacatcttttcaaaattaacctttgccatgatgtttgcactctcttgctcatatccacgtatacaaaaataaatacatagtgaacatattcagtctacaactctcagctccctggtattccacagtgtattcctaccattggaaaatactgtccacagtgaatatgtgtgttctcatcctgattgctgtaaaataactgcatatctaagtgttagggtttgaagactttaattgctagctacagagtgtctttatgtattgcacttccattttgaaaattgaattaaattgccggtcagtgaactctttataatgacaggagagtgtctatgcaagcaagccattgagcagagtgatctttggccagtgatacttttaaactcagacactttgctgaagtttgccactgaattttctcacatttccccagatgttattacattgccaaatgaaatcatctgttccccctagtagaactgcctcctttcctccagatatcagctacaaggtatgaaatgaattgcataaaaataaatcacacatgctgcattttgggaagagtactcttgctgatccattaatttcttttcactgctgagttgggaagtccactttaatcttcaattatcagtaacgtgcaattggatgaacctcttgacctttccaaaatagagatgctttcatgccaggaaatttgagctctttgaacatttgagaatatttttgcttttgatgaaaaaggtttgttgtcatgtgccgtgggagaaagagattgaaagaaggaaggttattcccaaaggcctgtttgatgattggactatatggctctattcctgaccatgtactctctgtaaggtttggcatggacagcaatgtgctgttggcaatatggcgcactttaaggtatttaagcatggactcaggagtttgtagattatccaggcttgttacctcatctccatatgcctagtctaccacttccacttagatgctctgccatgttgcaaactgaacagaagaccctgatgaacacaaggaagatgagggaggtgatttccatggagactgtggagaggctggagggtcttgtcttagggaagtttatcattcctttgcgcaatcttggtatttgtgacgtttcttttcttctttgcttctgtggaaagttggaaataagataattgggatagtggtttttgaaagggggaaaagtaattaagacacagtgggatgcccctgcctagtttgggaatgcaggctcagctctgctcctcaattgtttgagaccccagggtaaactacttgatctctagaatttcaggctcttctgtaaatgaggctgttggacaagatgtggcaaagattccaggaggccagggttttaaatttgagattagaatcttagtggaattttttgaattatggtttctctggctcgctctctccctacctcccttcctctgtctcgctctgtccacacacatataaacacacacagatgaagattttgtttttgtttggttagtgtattttatgttggacatttgtcagtttggcatttaataatatccatgtttcaatgtgatacatacgtgggacttggttaagtcctaaagtcagatgaactttgcttgtttacaactttaaaaaagaattccatccccttcttctgggagatgtagagcttggtagccagctataggtgtgctattgccaagtgtgtgtgtctctttgtgtgtgtatgtctgtgcattatacacacactttatgtaaatatatacatatatgtaggggtatatatatatacatattccaaaaatatatatatacatattccaaaaataagggtatgaggagccctggaggaattgcgggcacacacaaaatattttatttgaaagtataaataaattcatccaattctagatatgatatctcacccccttaagtaaatggaactcttacttgctgaattttacaaagagtgttacaagaagaacagagggctaaaaaatggtattcctagggccctattgtaaatatacctcaacgaaaggcaatatttcctgttacgttggttggcaaggggattttgatatcagaatgtggctccatctttcacattagaacatagctgtacgtggagatagagagtagatgaatggttgccagagactgagaagggtagtgaggggttacaggagaggtagggatggttgatgggtacacaaaaatagaaagaacgagtaagagctagtatttactagcataacagggtgactgtagtcaaaaataagttaatcgtacatttaaaaataactaaaagaatataattgggttgttggtaacacaaaggataaatgcttgaggtgatggatactccatttaccctgctgtgattatgactcattccatgactgtatcaaattatctcatgtaatccataaatatatgcacctactctgtagcaacaaaaattaaaaattaaaagaacacagctctgagctgcgacagtcagtgacatttaattcaaactcaaagtggctagtttatcatttttttccacttgcttttcttattattaaacagaggattttcactataggaaattagaaaatataagtaataaacggaaagtaaaagtcaagtgtagttctaccacccagagataattactcttctctttctgttcaatattagtccagtttttttgctttaggaatatgtatttgcaaaatgaagttgtactctaacacaattttagctaggtttttgcacttcatgttacaatatttttctgtcaaaacacctataaccctatatttaatggttctgtgatgatgtatatttacatattaaaacataatgagtgtatctcttcttgagaatttattttgcttcgagttcgtcattattatataaaattatgccctgaacatccgcagtatggaatggactttttttttgctaatacatatgcaaaaaagcttacttttttaaatgtgaaatttctaaattcacatccaggatgactgagcagttcatatacttgttgattagtgtcaaaatgctgatcctcccgtaaatcccctgatcgtcgtaggtgtttgcatttcattagcagcaaaacaaattaacaaaatttttgctagccatatagttttaaaagagtatcttcttggtttttatcttgcatttctctaattagaaatgagaaatcattagttagtaaatatcattagttaactactactgtggaaggcagagttcatggtggaggctagtgagcctgttctgtcttcatgggctgtgtgtcagatgcctctctgagggcttcaccgcaggcagtgatgtggtaaggcagagccaaggccttagaagttctaaaacttcccagtataatttagtaacaaaagatttttttcctgaaactcaagaacagtgttgtagatagagagtgggtcacatggagtccccaggtaacgtgtgaagctatctctatcagtcagctaaggctgctgtaacaaaatgccacagactgcatggactatgcatggaaatttattttctggctgggtgtcgtggctcaggcctgtaatcccagcagtttgggagaccgaggcaggcagatcacttgaggttaggagtttaagaccaacctgatcaacatggccaaatcccgtctccactaaaaatacaaaaattagctgggcatggtggtttgtgcctgtagtcccagctcctcatgagactgaggcaggagaatcgcttgaacccaggaggcagaggttgcagtgagccaagatcacaccactgcactccagcctggactctgtctcaaaaaaggaaagaaagaaagaaagaaaataatttatttttattttctaacatttctggagactggaagtccaagatcaagagtctgcagcagagtttgtttcttctgaggcctctctccttggcttgcagatggccaccttatcactgtatcctcacatggacccatcctaagagcttaattttaaattaatcaccaccaaatacagtcaccttttgaggcactagagtttacggcctcgacatatgaatggggggacacaattcagttcataataggagcagaaacacacgcactaatcaaacataaaataatttaaaacagtctagaggtcttaaattgtgcctctctctgagtgtagacagtgcatggagactgccctccccgctgctaccccacatcctgagcgttctgtcctcgtttccactgttctgctccattgtgtgggaggagctggagaagagactctgtttccaaggaagtgtggcctatgctgctctgcacctgggccttgcgacagccgctgcctccaaccaccacaagtctactgctgttcccactaataagtaccatggaaacccagtgcatgccaggggctgtggagaggtgggtgaacatcaaatcaccagtgacactggcttttcaaacgtcacatcataaaaatagagccacctgagtaagagcgggccacagcggcatcctgtagctccctgttttttggcatctacttcccttgggctcacagtcttctccatgaccagcaggaagactcagcactgcaactatctgcacgggttggtcgggctacacatgcctttccctagcatattgctaacactcaaaccagaaactgattaatttgatttgggttaaaaaatctgaccccatgaaggctttgctgatcattgacaaatctatccttcaagcattacagttttaagatagagggatgctgccttagtctctgccttttttgccattaaaaaaccttgaaaatgttatatcatagatagatacattctaataacagccccaaaactgatagatctgcatactcagattattgatcccaatactctcagcagttttaagccccgcccctgcccaaagggaacccctaccaatttaattcaggaggcttttggatttcatttaatgtggatgttatcttgttttgtttctcactatctgatgctattaccatcttaattaggttgaaaatcagcaattagaatcagaatgcctgtaatagttgtttttcttttgatcatagttatactcttaatgatgagattatgatgtgtgtgtgtccacgtgtgcatgtccatgcgtgggagtgtgtgttgtaggaagagcagtggatgttaagtcaggaagataagcttgaatgtgagttttgcttcttctaagatacctgaacttgctggagtgagcctccaggagccccagggtcctcattcgcaaaaagtgagggaatggctgttccttagattaggctgctttgaaatccatagatatcaaaccatcttataaaccaaggtgctgcacagattaataactgacacattggaagccgaggagtgtttagatatgtgggaactgggggcacattgaaatcattactagagggtaaatgttatttattctatgagctaattgcgggatttaaatttgggagctaaattttatcttaaatgttaaatattgtacgtaggaactggtctttggggggacaaattcaagctagtaaggactgttagagaggagaatgatgctgtgaaaatttaaatcccacaatgttgtttactagaaagatatccatttccaggcatctggacatgaatttctcagcctttgagaaaagccaacttaaccagcatgccctttcgatatgattgctccggaagcgtgggatgctcagtttgaaactgagttgtatgtcaatctctgatatctcaatttctgacacactgaacacaagcaggagaagagatgtacctctaaagagtgaagaactctctctctcactttctcgccatcctatctcgtgccatttctctttaggttgattgtttttaagaactggtgctcagtgcttagtaaagaatacttttctgaagcatttctcccaaagtgtatcttgatagattctgcaaactattaagtaagatttcatatgctgagatggtgtaaggtgatttatatttttggagaaagctaaaattcatcttactgacttttcaatctctccttattttcctcttttccatatagatatttagaaaagcaaagtatattagtagatttaatctccagaggatgagaatctagggctttttttttttttggttttctttaaagattgtatgataaaaaatgtttattatggcttaagggggaatgaaggtattcagataagttaattacatgaacaagcatgcctgattcctcttccacacagcctgtctcaagatccttcattcgtcaactatttcttaagcacctactacttgccagatgctgttttaggcacccagctccagagctgcaataatgatggagattttctcaaacccaacacccctggagcttacattcccgtggagaagttagataggaacaggtatacaagtaagataatttcagctattgagacatgctgaacagggttaggataaaaagtttgaatttatataggtgttcgggaggccacagctgaggtcatggtagttgaaatgagttcaaattagaagaagccagaaacggcaatacctgaaacagaagggtatcagaaagagaaaaatggaagttcaaggccctcgagggactgaaaaatggccagcgtgcctgagcataataaacatgctaaggagtggtaggaagtgaaatgggagaggtagaaaaggtcaggcacataaggaacttggacttgattttgttgtaatggaaaaccacagggacctaggtaggggaaggtgttgatatgctgtatgtttttaaaaagccactctggatgctgtgtggaactgcactcttgaaagctacacctggagacaagaagctaagtgagaaggccactgtgagatcctggcagcttagactagagagtggagacatagtaggaatgtgtcctggaaggtgggaaagaggacttagattgaaggaaaaacaggaatgaataaatcaagactccctcctaggttcccgtcctcaataagaggagggatgataccattattaactgggatctggagggtagagcaatgagttggattgggtggggggatggggcgagggataaaagagtggttttaagcatctggcattctccatgcttgttaggtgtgcaagtgaaccttttgagaaggtaattggatattgtgtggaagggagggaatagacatctattgaaagaacaaatgatatttaaaagggtggtggtgcagggaagtggatgtggagacccacatcagcactgaaaaccagtgatgggattatgcacaccatatagactgggaagtgacagggaaattcttgtagatgtagtgcagtggggatgttactatctctagtttttaatccagcgtgcatttttaatcacatgggggagatacaaaaataatatacccatgccccaggccccactgccccactgtagaccaatcagtctcttttttagagggaagggtaatggcaggcctcagtagtttttataaagttccccaggttattctaacatgtggccagggttgtgggcagctggattagaagaaaggaagggatggcctgctaatcctgttaggagggtggcccctggaactaggaagtggaagtacctcagtgcaacctcacactcattctttggagaagaaaaaggaagaaagtgagggggaagccaagtgtttgagcagtggagatgggaatcacaagacccctgccagcaagagcctttattcattcagcatggttgtcacatcaggggaagagcacattctggcccctaaagacgacaatggttgaagaaaaggtaaaggacaacttcccagatagctcctcagtgacagccacgtgctggaaattcttcagcctgaggtgaggctgtccctgcaactgtcagactcagatccctctcatctccagggttggctgaatctactatctgggcaaaattatgtgcagacaatctaaatgtttactctctatgacagtttgtcagtaatttttagtatgggacccagggttattaaaggcagggtgacatgggctgcagtatgacttgatgtaaaatatttcagcatgcattcttatctttgaccattaattccacttttaggcctttgtccaaaataaataaataatacgtgtttgaagagtttttttttttttgtacaagggagaaatacttgaaatatttgaaaagatttgctgacatgcattttctactgtgtaggcattgtaaatcatttctttaaaatcagagcatgagaaaacatataccatgtaaggtgaacttggaaaaacaggtttaaagttatgtataactgtggttatacaggaagatttcagaaaacaaacattggtaataaatacaccaaattgttaaaagcagctcttgctgagtgattggattatggtcaactttaattttcttaaatttttcatttacattttattttatctcattttaaatttccttaggttttcaggcagctcagatatcccacagttttagtaagaacacatattgaaatagtattttaaaagagattgattaataaggtcttaattttagatgagtttagttatgcatttttaaaactccgattctccaaatttggaataatggtttctgcctctcagagctgttacaagaattaaatgagataaccagtggggaaccatgctgtgcaatccctgatccatgttacaatttctttagtatttttgcactattgcctctgcttctaccaaggaactttatcccatggaagtgctacctttcacctaacattttgttagtttacgtgaaatagtcaacagatatgaagatagtttcattatttatgctgattgaaatgctgatcattggtgcaaaccggcatcccagcaggatgagctgtgattgggtgaaacatccatcatgattccatttctctttgccagtgactggcttggggttgggcattgtcctcacccaggagaggtaagggggaatgtgctggtggcagcagggaaggatttcatgtcctaattaaaagagagaaagctcctggagagtgtgtgtgttctgacctgtacttactctctttcaatgggaccttggtgcctggagctactgaagctgccctgggaccatgaagctacaggcctgaagatgaagggcctggcccctgttgactccgtggagctgccaaagcaactggaggctgtccacctttaggcatcttgttgagtaaacactcgggcgaagtctgtgggcctctgatagttgaatgtttgtcatacacagtcagcagcagtgcagttgacactacctgtggaagttgacatctggttcccaaaaacaaatagaaaggttggtgggaggagaatctgctgtgtgtttacatattttaaacatgtatggcaccctaggtttttctttctttttttttttttctttttattttgatggaattttgctcttgtcgcccaggctagaatctccgcctcccgtgtccaaatgattctccgcctcagcctcccaagtagctgggattgcaggcgcctgccaccatgcctggctaatttttttgtatttttagtagagatggggtttcaccatgttgtccaggctggtctccaacacctgacctcaggtgatccacccgccttggcctcccaaagtgtgggattacaggcatgagccaatgcgcctggccggtttttaacgcacacttcttataagtgcctagcgggattacaggcatgagccaatgcgcctggccggtttttaacgcacacttcttataagtgcctagctaacttggcaaaataatttcatttggtattcatacaaatttactactttaaattactccagaaattaagccaaatgaattttggagagtctgagaatcttaaacaaatacgttgtgaattacaagtttgcagaactccatatccagtgtcatgtcctgagatttagattcgcatatcagcaaggctactgctaatgacgctggggttttcaggtggacactgattgccacagtcactgaaaatttcatttagctgaattcctggaaaatgcttaagatatttacattttgataatatagaaatcaagagttaagctaatctaaaatttgtttgtatgttttataggtatgatttacccaattttgctgtcctgagaggaaatattacaaatgatagctaggtttcttagataattggagaaagtgctgtgtaaacatcaaaatattcagggcatttgttattatttatgcagaaatatagccaaaatactggcatattttcagttagcaatataatagtaataatagaaagtaaaacattttaaaagaggtttttctggaaattttttcctcaggatcacaaaaagtttttatttttcataagtatttcagtgatataatgagcacaagatacgttttgatgaaaagtaatgtttacatgaaaaaggaaatgcttattgatatttaaagacaattccctactctctctccttttccacatggtgaagtcgggagctccagatagaaatccaaagagagagaaagacaggggcagggaaggtacagtgtggaataatgtggactgtctcacatgacacttaagaggtcatgtgatgctagtgactttgctgatgtgtcaaggctagggctgagaggctgtgtccagcactgtcatctccactacctgaggcagaagcagaactgcagccggggcctccctgtgcttccagcactgaaagtaaagtgaacaagggttatgtggtcaacatgtgtgatttcttatagggaattttggttttgtattactaaaatacatagggtctggtgcaatgactcatacctataattccagtgcttttgggaggaaaaggcaggaggatgtcttgagtccaggagtttgaaactagcctaggcaacatagcgagatgccgtctctacaaaaatgaaaaaaatttgtctgagcgtggtggcatgctcctatagtccctattacttaggaggctgaggcgggaggattgcttgagcctaggagtttgaggctacagtgataccgattgcatcactgcattccagcctaggcaacagagcaagactccatctctaaaaaagaaaagtaaaataaaatacatagcttatgtatctgaaaaccttcaccattggatagtaaaaattcaatttattataagatcttaaacagaatccttgagaaacttaaatatagttaactctaaggttatgaggagagattgtgggacttggaggaaaggttagtctgtaccccaaatcacatgatttttatagaaagaacacaaaggatggttacctgtgggcacattctggaccacttacatgtttacttaacaacagttccagcagttctctagtgtgtgtatgtgtgtgcgtgtgagtgtgttcactttataagcaggtaacttcctgcctatataaggtaactttcacggatttcagacagtgtaattgtagttactgggtagaagaggtctttcatgaaatttgcaaggggatctctgcgtattttgtgagtttcctcattgttctctctataattaacctcacagggcagaggatagtttcttttcttatagatccatatcacaggcatgattctccagctgaattcctgagctcaagatttcctttctaaataaaggaaagggaaagaggattttctcgaggtaatggacaagagttgggaaaagtggttgcagatatgcttgatgctaaggaagccctggtgtatggactgttatgtgttccctcatcccctaaatttctgtgttaaaatcctaaccccatatgctggtattaggaggcaggggcctttgggatgtaattaggtcatgagggtggagccttcctgatgaaattgatgtccttagaagaagagagaggagagggcttgctttttcctttctctgctcttgggcatttgaggatacgggagcaggggatgtctgtaagccaggaaggtggccctcatgaaatagacctgccagggcctcgatcttggacttccctgcctatagaataatgagaaataaatgtgtgttgtttcagccgcctagttcatggtatatttgttatagcatcctgcactaagacacctggcttgcagagtgaggtgccttataagaaggtaggatacgtggtttacacacaggtagccacagggtgcagggtgcatctgtaagtcaagtggttacaacctctgcctctctaggattaaaatctttggcactggagcgaattttatgatccatcttcctgaaggaaaccaataaaaataatagtaaaattgacaactaactacactgtattgagcatttcctaagtacttgtcatgggttgtaaacaacatctcactcagttctcagtacagtttgatgggacaggtactattatctccatttcactgaaaaaaaaggaaacctgaagtgaacgataattaagtttcgggcccaagttctcccttcttatgatatgatggttaggttttgtaaccagggttatgatttaaaaatctctgttccatttccccccatgaactcttcacttatactctaaaatatctcaaaagatgcttgtactacatgtaatatggcatgcgaggaaatggattttttaaaaaattttttagagactcagaggccgggtgcttcaggctcatttttaccacctgacccgcgggtacacagcatgtaattgtatctcaaaatcatttccagatatgttggaaagagcaataggaccagctgtgtttctcataaaagattaggcacaagtcatgtatgaggtttttctctactctgacttgtgaaagtccaagcagtgggttaacatgataaaggaaaacaaaattaaataagctggtgtaagcataacacaactgacttccagaagggagataaatgttgcatagagacatcatatccagccaaattgttgcctctggtatttccatttggctaatagtgcttaatattggttgaaaaataaaagtatgccgagaactcgtatatcatatggtcagcattgcatggtttcgaacactccagtgaacccatctggagagtttcagccaccagggcctgacagcctcattagctgcctccacaaggccttgcccaagcaacagtacaaattgctgttgtttcagggcgatggtgcagagttaaagaaaacaaacatgttcaactgttttgtgttttccatgttaaaacctaaagatggaaacctaattattcagagattccagcagaacactgagccctcactctaaatttttacagcagttatcaatgtgcttaagaaatgtgaatcaggaaagtgagtcacatgctcaacatggtaaacatgtatatatccaccttcaagacttcagagtgtgtatatatatatatatatatatattttttttttttgtttgtttgtttgttttggagacgaagtttcactcttgtcacccaggctggagtgcaatgatgcgatctcagctccctgcaacctctgctgcctgggttcaagcaattctgctgtctcagcctccctagtagctgggattacaggcatgcaacaccatgcctggctaatttttgtatttttagtagaggtgggatttcaccatgttggctaggttggttttgaactcctgacctcaagtcatctgcccgcctcagcctcccaaactgctgggattataggtgtgagccaccatgcctggcccagagtatatcttaataaattattatcacaaatttgcatcctcatggaatctgagtttggaggaaatctgatgagctcccagtttaattatcatccctggtataaatctcttgactgttcccagacagaaagggttgcttagtctctgcttggactccttcaatgctaagatctccttagactttaccttttgattccagatggcgctaatcattgaattactgtctcattagtcaaattccaccttctacgcctgttcttaattctaccatctggggccaaaataaggagcctgtccatgttccagcagacttttaccaggtgaggacttcagtcgtattttcactgggccttttcatttctcagataaatcagcaatcttttgtttctatggcagggtttcatgttccctgcagcattctggttgttctccttaggagtacagttgtttatcccaaactcccaaaccgcctcctttgtaaagaactgtgatcattggcaagtaatctcctctcagcccatgtttcctcttctgtaaaatcaggatatcatggtacctgcctcagagggttgctgtgagaatgaaaagagatgcagtgagttgaaacacagtacccagcaagcagtaagtgctgaaaaaaataagagcttctcttaccaaagtatctcttaattcttaatcccagtactaaataccaggcgtccagaacaggaccatcctgaccctttcatgcagtctcctcctcctcccggcttcatataattcatgaatttagcatcatgctctgctatctaactgtatcaaaaaaggaaagggctttcatttggctggatccatggttcatgagtccacatttgccttaagtgatcactgtttccaatttttatacacttacaaaccactcttcgtttttttccttagttcatggattctgtcatcttccccttgtggaaaatcacaaccttcttcatgtcttcagagttttttggcagcttttcccactctccaggtttcccattcctctaggtttgtagaacgtgttctaacctgcaaagcctctggctacctggatatgttattttttggaccacagacctgagttacagggttgagttgggaagttctctattaccgggcatttttttctggccttcccacagaccatagaatcagagaggagttgaaaaacaatattttcttttatatcttttagtgtcgtttatatagccaaagcaggagacagaaaaacacccttgggcaattcaatagaacataacttgagagacctggacctctgattagtcttgtacttttgtcataatttttggttccttctggaagttaaggccgtttcctactctgtttttacaggccattactggcaatcagcatgcagtttaactgtgcccagtttttgtgttttcttcatgtcctttgaaaatcagccctcacactatggctagattgaatgcattctgtgcatgcattctattctgctctaccctggtattgtttgtgttttttgcataattggaatttgccttcttaagaggtttccaaatctcttgggccatctttattagaggaagcagcactgtacaaatgtaaatagactttaaatatttctttagccctacagtttataatgttgtttggtcatgtttctttttaaagacttcgggattagagtaatatgtcttaggggcaaggagactcttctaggtattctttgtcttagtgactttattaaaagggtaccttgttgtaatgtacttacctcacaaagtttttgtaagaatttaatggctgttgcaattaacacgtaactgggtgttacagaacacccagagtagtgccaggcatgtgttcatggagtgttggctactactgctgttcttatcatcatcatcatcatcatcatcatgttcattggaaacgaaaatttcagtttcaaagaaaaaaaacagaccctgctcttcaatacagtatgcagccaaatgttcgtttcccagatgctctcattttgtcctgaatcacaattgttatttcaatgaagagctcctccttcattcaattgctattgttgtgaatactattttaaatagagtgcttggagaaggcctttctaaggatgtagcatttgagaaatttctgagaaagccaagaaactatctgcagggcatgtaggtgagacggggaagagcatgggcagtgaccatgccatgggagtatgtttgtcctgtgcagaaacagcatggcgtccaatgtgacatagagtggagcgaagtgggctggcaagaatatgttgccacgtgaggtctgagaagtagccagggtggggttacaataagaactttgaatttattctgtgagagatgggaaaaaattagaaactgctgagcaggagtgtggttggcttgtgtagaaaatagacgagatggaggcaggagtggaagcaaggagaacgtttgcaaagttatcacagtggtcttggtgaaagatgctattagcatggcctggagtgggagcaaaggagcgggtgtgaggagttctgatttcaaagatattttgaagatagtgtagagcagtgagggtctagaggattagtcagagagagaaatcaagtagaactggagagttctttgtttatttgtttacctgtgcaaaccagctacttttggagagagaagtactagagtaggagaggtttggagtggggaagtcagtcctttgttaaatttgagatgcctgttagacttccagtaatatatgtgatcttaggaaaaatagcaccatttgaagacttttctagcttccatttgttacctgtgtcacacctgatctgtttctaggaggatgtcaattatttaggagaagaaaaccaccaactaaaaatttaaacaaaacaagtaatagacttggtttcaaaatcatgatctgcttcttttaagagttataggggacctgcatccactgcctaaatgaaaacacagtcccttccaaatatacatttgattaattagaagctcaaagctctgtttttactgctttaagagaaaaaaattatcaccacattatagtggcaatttctctgatggaaactgaaatagtggatgatgatgatgatgatggaaatttcagagtagcacacaccttattgagtgattacattttaaaatatatgtgtattcatttattcatataatcgtttttaatgagagcactctcttaattacattatgacactgacttggtaaaagagaaaaaagatctctactgaaactatccctaaaggagctgatgttatggaaactgagatttttaatatttttagctgagaatatttatattaactggataactgcgaagatcacctccttttgactataaatttggagctgggttgtacagaattatatttagctctgggaaactaatcttaacagtgcatgttttaaaatagtaaggcttctcagtttgtacaccaaaattacagactccttgatacccttcttccaaaattttcagaagttgggacttagaaaagtttcattttgatattagagatggtatcttacagcactctgatttgaaagctagtacaatgaggtgactctcaaagaacaaaaggaatcaatatgcctaattgtgtttattgctactttttcatctttgctagatgctttagaagacaaaggccctctttaatttgttgatgcttagatgcatgatgtaatcttcaacagactgatctgcgctctcataattccaaagtttcttcccgattgcttgataaaaatgcaaccttaggtatgttttggaagacctccaagttatttcaatgttatgcaggtatatagaattaatattattgatacacatcttagcagtagaaacattttcaattatgattagaaaacatctttcttaaatgtcatcatttgatatcaccagtgatatcatagtgaatatttaggcaattttatccctgggcctagtccacacacatttttctagtaaagttgactaagacattcatgagccaatacaatgagcctatgattggtaacagggtggggaatgtctatacctttcatatattgcatcccaatattctatagtaggtattgaaacatgccgtacccacttctgtgccaaggagttttgtagaggtgatgagtcaggaaatccaagttctgatctgattctgttagaagctgattcactggctttgtacaagttatttcaagtttccagagattggtttccccagccatatgattacggggttcaaatgattgaactttgatgtttcatgttaaaccacctttgttcctctctatgtgggaatgggaaaaagtggacacctcagtctcgaaatagaagtttggggatgaaaaaggagagaaactaagtttgtaaccacagaagtgggggtcagacagcatggtttgagcactttcatgaatgcatctggtgtcagctgctggcctctaaaactaagtcctagtgttcacctgagaaggagttatctgtgttctctttcccatactgttttaccagtaaagatgatgatgagagaggtggtggtgatggtgttgagagtgatggggttggtggaggtgatgggagttgtactagttttctaggactgttacaataaagtagcacaaaccaggtggcttaaaacaatagaagtgtattctctcataggacctgaggctacatgtttgaaatcaaggtgttgggatgtacctctccctctgaaggctctagggaataattctttcttgcttcttttagattctagtggttgctggcaatccttggcattccttggcttgtagatttatccctccaatctccacctccttcttcacatagtcttctcatttgtgcatctatgtttctatgttcaaatttctttcttttttaaaacacactggccattttgggtttaaggcccattctactccagtctgaccttattttcattgcatctgcaaaggccccattttcaaataagatcacattcacaggttctgggtggccatgaattcttggggggatgttgttcaacccagaacatgagtggtggtaatggagatgggatggtggtattaacgggtatggtagtctgtggtgagggtgttggtgatattgatggtagtgatgatgtgggggtatccaagggttccatctcacatgatatgtactcagttgtagcaaaaatacttattgtacattgatccaaaattggctgcaaacctgtgactggttcttggcacatgcatcactacagagtaacaacaacataaaaggcctattgatgatgtcttaagggctctttgagaagtaaggggaggcagaaagcagttgtatcctcatgacaccgaggcagatgtttccgtctttaggaaggaagacagcatttctctgtacaaagcactttcagtttttacagagcaataatatttaaatgtaagacattcaacttgtaatcaaaatgggaaatagataataagacctttaaaggaaatatgcgtgatgcttttgtagtccatgttcaggatcatcttcctcttatttcttataagaaattttacaaggtctgtcctcatgtcattcagtgggcctgaaattgtatctgtttttccccttgctctaaaagttatattgaaggaatgattttgcactattgcacactaaaaaagcccctactcagaaattttaaaaacatctaaactcatattcagatatagtggagtaaatgaataattgtttcagccagagggttttctcaattagcattttaaggtcaaaatttaccctagaatcctgtagaatcagtggctgtgagtcacctactctttcctttcacataatctatttcttgctgtccacctactaggcaccaagtgaaataataccctttttatgtttctcagctctagcttgcagagaagagtaaagagaaataactactcagggcaggaagatatttgcaagaaggtagcaaacccccaaatccctttgacggtgggaacatcaaactgagcccttgaagactagagttctgggtactcaataatgttcaaagtaaaaatacttcagcaaattggatcaacactaatttataaactaaattaaacaacatgcattaaatgtaatctatgggaagccacaaaatattttgctttgcatattttttaaccttagtgataacaattcttagaccaaaatagaaatctccagtgttgcctgtttgtcaaggaagccttcttcattatatttcaggtggaactaaggagcacaattattttgataaacttcttttttactttttcattttctagagatagtgtcttgatctcttatgcaggctggagtgcagtggcgcgatcatagctcactgtatcctcaaactcctgggctcaagtgacccttccacctatgtctgtctcctgagtagctgggactacagatgcatgccaccatgcccagctaatttttattttattttattttatagagaaagaatcttgcaatgttgcccaggcagatcttgaactcctagcctcaatcatcctcctacctcagcctcccaaagctttgtgattgcaggtatgagccactgtgccaggcctctttcttacaactttagaatttttccataagatttctcctgtaggtaaagccaggttattcagtggaacttatccttggaatatatgtaaatttgtgccagcagatttttttgtcttttttatttggttgccaatgttatgatagccatttctttctcatcagtttggttcatgctgaatgccttgtgttggtgaaccttactgctatgtctttattagcaaagcctcagaggtatttcggcatttggccaaatatttgcaaaatgtgccagttagtcaagtggagaattcatttatttttgggcaaataatgggtttttaaaatgggattttcaggtaaagtgctactacatagtgaaagcctgctatggtgcaaagcctgctatggtgcaaagcctaggagatcaccaagaaccagcccttcccttccctccatttcctgggaatcacagtgtcccaggaagctctcatctttcattagctattgactgagagagatttttgcagctgcaatggaaatgccctctcgacagtgtcacttgcttttggtttaagcccgaaaaaggtacagcaggtcaagtcccatttgctgctgtttgactggagtgtgggcttgtgtgtgtcttcaccctctagcacagacttgttttttttttttttttttttttttttgatgagactacaaggaagaacacttttccttcactgcatgtattttactgttattattgttgaaaccattccttccacctccaacctttccccgttaccacacacacacacacacaccccaaacccgaaaccaaccacaacagcaaaaaacccaaattatataaagggcaaaggtaatgcagttaatctctgaattactttggattcctaacaaagaaagaacctaaacaagaacagcatctgtttaaagtaaaagaatgttttcttacaaaaaatattgttattgcttattttagaattgccattatgcttctgaaacgtactatgagagtaataaatgttaattaccagagattagaaagtgcaggcaaggagaaagataaaaaaagtctccaaaattatactcaccagaaaaaaacaatcaccgttagaaatctcagggtaatgctttccagatacttctttttctttttccttacttttcacatttttttcttttactttttgtattttattttatgctttggatggggatgtaggtatatgtgagtgtatttgagtgaacacaagtatgttttttcatataggtcatgatgatgatgatgatgattacaggcagtctttctctgttgctcagactggagttcaggggtgcagtcatagctcaccgtagcctgaaactgctgggctgaagtgatcctcctgcctcagcctcctgagtagctgggaccacaggtgtgtaacaccaaacctggtagatttttaaattttttgtagagatgaggtctccttatgtttcccaggctggtctcaaactcctgggttcaagggattctcttgccgtggcttcccaaagtactgggattacaggcatgagccaccatgcccagcctatacagaatattattttgtatcgattattctaaaacggcttaattctttcatgttctggtgggggagcaggtagcagagtgttataagagagaatatcccagaataagtgaccagagaaatcctttttggtgaatgacatttatggtgagatattaaggttgagatctgttgtcatgctaagaatggggagacgaactttgtaggtagcagggatcccagttgacaaggcctttgggtggaaggagagcttggctcactcatgcatctgaaagaaccagggggctgaagcacacaggaaactggagagacaagatagaaggtgggcagggatcagatcatccaggcatcttcaaggccatgcttgtttaacttaatgtattgtgactgtctttctgtggtcaacattctaaaagcggtagattttggtgttaagagcctggccactggagtcaaataaatccattgtgtaaacttagacaagctaattaatgtcccctagttttaatttccaaatctttaaagggagatgattgtaggcaatgtctgaagggaccattggggaaaaaaagtcagattatacgtataaaacaatgaagaggctggcaccacttttaatcagttttatggttgaatttattcaacactcattgatggagtaaccaagggcttggtcaagaaaggttatttagcagaagctataatggagcttcaaagagcagagcagtgaaacttgtacttctcctcctcaccacctttggaataatgagcccaggtgctccattgaccagcgtcctcatgcagagccaagtgctattactgtctttttaagttcttaagggcagaaccgtggcttttcttacttgttcttacccagcaccatactctcactcaggacttttttcttttttttttttctttgagacagagtctcactctgctttccaggctggagtgcagtggtgtgttctcggctcactgcaacctctgcctcccgggttcaagtgattctcctgcctcagcctcccaagtagctgggattacaagcacgcaccatcaggcccagctaatttttgtatttttggtagaggtggggtttcaccatgttggccaggctggtctcgaactcgtggcctcaggtgatctgcccacctcagcctcccaaagtgctgggattacaggcatgagccaccgctcccagccagcacttttgaagtagagatggttggtgaatccacgtggaatgtctgataaataacgaaagccaccgtgaatcacagccttttctttccagaagggagatcacacttttactccagtgcagactttatgtatatagaaaaattgaaacatactttaaaagatgtttaaaatatatttcagcttttaaaaaggaggttgaaaatctgtaaaattgtatgattccattaaaaacatggcatacatccagagctcttgtggcacttgtatcaagcggtacagctatgcacactctctaaggcgggcagctgtaagggctgtcctctgcttctggcatgccacattggctaaatatatcgaccatcacctctgcatgcacagcagtaattattgacgtattcctgatggttttctctggctgtgaaattatgggaaattaaatatagtttatatttttacaatgaacacgtattacctttataataaaaaataaaattaaaaatcacttaaaatttcttcaattcttttcacactcctcttcatgtaacttcatatttgtatccagcactcacaactccaaggaccatgcccacgtattcttttagaattttaaaaataaattccagtaggtctttcaaatactgaaatctcagcactgaagtagattgcagtggggcatctgatgggtacatttcaaaaatgctcaatttgctcttaggagacttgaattggccaggcgcagtggctcacacctataatcccagtactttgggaggccgaggcagcaggattggttgagactgggagttcgagaccagcctgggcaacattgcgagaccctgtttctgaaaacaaacaaacaaacaaacaaacaaaaatttaaaaatcagctgggcatgggggtgtgtgcctgtagttctagctactcaggaggctgaagcaggaggattgcttaaactcaggagttcaaggatgcagtgaactgtgatcatgtcactgtactccagtctggacaacagagtgatagcctgtctttaaaaacagaaagcaaaaaaaaaaaaaaaaaaaagaaagacatgaattgtatgattccatttttgctttggtcatttactgggtgtaaactcttgggttttccttatctgtaaaacagagaaaacagggcctcctttatgtgagttatagattatctgatgattcaaataagatatgaaagtacttttaaactaacgacacaaatactagctgctatttatttaagttatgattcattaattagtgtatcctgtgaaggctccagttttgtttttatcaaagatcacgtggagaaatggcttgcattgggataatttataacttattaaaagtttgcttctcattaagggactattctctttggaaattaggtattaaatatatggtttttgtggcaacactgggatgtgtgctgtactgctcctccctaaaaaaagatcttttttatattttaagcattaatcagacttgaggctatttgctttcccatcctcagaccctcaagtgcttgttgtaggttggattgtgcttgatattcagaattgagtataaaagcatgtgctctgctcgtggttggtcagctgccttggagaggctagattcttcatcatggcacaattacagaaaaatacagggttttcctgagtggccaaaaaggagatgaggtgggtgttgggcaattaggaccttatttctttaagtttctcctgaaattgttaaagtcagctcacacttctttagttttttttttttttgccaaaacacaaggcatcaaataatgttggaaaatatccttggtgctcagctacagaagtttcttgaatccacaagtaataaggagctatttggcatcattaaatacggagtgtgggtttatcactccagtaaatgaatcaggagagaatactgagttagcttcctgctgagatgtggaggacacctggagtttatctagcacctctctgtgagatccctgagagcctcctcgatgagaatgcaggtttattccttctacctgctgaggagacagaaaattagcatgataatggtgataattgttctgtcctctggacagcctggacatcagggaagctttgaggtttcagtaaatgcttacttattcctctgctcttggtacaggcccgtctcttggtcaagatgagagatacatagaaatataatataagccccatctgtaaccatatgaaaaaagtaaaaagaaatagacaaattaattttaatgatctcacttaacatatctaaattattatcatttcaacatgtaatcaacataaaaattaatgaaatattttaaattctttttttagttgtatgctacatattcaaactctggtgcgtactttttacttagagcatgtctcagttcggactagccatgtttcaaaggccttttcaccacttatggctagtggggaccatgttggacagtgcaggtttattccttaccaacctggcccatagtagaaagtgctgtttccatgagacagcctttactcctcagtaagtatttactgggcatctaatatttgcagtttactacattttggttatataaccatataacttgaatttaatgaatgaatcaagaaacataataataaatagtataagtaaagtttctggatatctgtttgctaactgtatgatacagaagcagctgagtatgagttttcatgaatttgcagtgtagctttgggatcatccaagttacaattataggctaggtgacataaaagacattggcattggggggctttgtgtagcatcaggaagagctagacagtcatctcctaaaagcaggtgaaactgaaatagaataacgaacccaagggtctgctgtcgaagagatgtagtgtactatttaggtgtcagagactgaaaaaatacatagtgaaggtggctatgagcacaaactctagtagaagggcaggcattgctaattacaggccttgatttgtatttgaggcacatcttttcttgggcatctcctgagttccatgaggacagccaatgagtagtgcctaataattgtactgcctttctgccaggtgccaactcatgttcgccaatgtttgaatacattttcaaacttaatttttacaaaaaatgtcatgaaataggcactattattatctccattaattaatgatgaaattgtaaatacactgatgttaagaagtgggactaggaccacatgggtattaagtagagggaccaaaactttggcccagttttatccaaccccaaaacatataattttagcttataattctcttcaaattagacaataccatggctcaaaatataaataactagtcagagattaaaacatgtatctgtatgaatggagaagcttgattgcatgtctgattttaaccagcttagattaaaattaaattattaagtgtacttaaattaacttattcaagaaccaattcagaggccactttctataaagagccccacttcaagtcccttatttggaatgcatctctccttcctcggctctccccaaacaatttacacatctcttggtgcataataaccttctcttttgattatagttatacatgagcatgttttatctgccttttctctccagccactacgtgtgtcttgtacacaaaatagctcctcaaaatatgtttcaaatagatgaactaaatgactagatggatggaaagatgaacaaatgaataaataaatgaataaaactattcctgtccccttcaaaataagagaagtgtttgtataaattaccttgagagtaggtaaaaaccctttgcaaaaaaccccaggggtaaaaccctttgactatggcaataatatgcaacataactattgtaagaggagggcagttttaaaaattcaaatagtcatgtacttgaaatattaactattcaactatgcgtgtactggtttatcatccagcacatagatacagtttgtctttcacttcacaaagctagtttcatgcattttagaaaacgtgtttttccctgacccccctccaagctgtacttgacagggacaaaactgagagcattgggcactgcaggaatcattgtgagctttcaggaggggaaagtcatttctatgactagtacttttcaggagacatgggtgtggttttctcttttcgcatgttttagacaaaagtggcggactgatgagtttaatacaatggaataccatggcttgtgcatgagggagtaactttttacaggaatgtttattatctttgtcatccgaatccatatgccatgctcagaaaatacaatggatctgtgtcccgagtggaacagaaatagttttttcatgctgaaatgtgttttggtcaccatttgacatttttaagaagcagctctgtgaaatatttttgaaagtggatttatgtattcatattcattcatgtgctgttttttcatctatatattccccatcttattccagaaaggatttaagctggctcatgcatttgttgtatttggaatgtttctttataggtcaaggactagtttcccagtgaattgatttaaagaactgcagtcctctgactcaggcttgaattcacatatgatattggccatttgggatatctctctgttatatgggcagagtaaacacaagtataaatctgtgacaacattttggatttctcagatcaggtactccatcatctgctttttatcacgtacaaaagaaatacaaggccatttatttccctattaccctgtgttctggatttttctatttataaatgatattttatatgctctgtttagcagttagtaatgaagcataaagggaagccattttaattaatgccttatttgcatgtgtagcatgcacctcttttctttgatattattggaaaattattttaaattcagtcaaaagaagatgctttaggcaaatgaggacttgctgatagagagctgtattattttattttactaatgaaatgctgttaattttttctctgtattttacctgctgcaactggtttccttgactttgttcatactactaggatttttgcaaaaaacaaaaacaaacacaaaactggccataagcattgaatagaatcattgcaattttctgtcaaacgagttttgaaatacatctggtgtttaacaacacattgcttatttatttatttatttcaaatcattaactactattgcatcataacaaaacacacacacacacacacacatacatacacacacacacacacacagctttggttcaattatactatatagccctcctgtttccattgtgtttgggggaagtaaatgtaataaatatttttaaattcagtaacccatctgttgaattcttgttggaattaactgagagtttgtatggaaaaggcttagcctagaacttcatatgtatgggactaggggatagagcacttgaagggatggcatgggccccagggctgaaaagaagtgctgagttaggataggatataagaatatataagaataggatataagtgtggcagcgctgaaaatcagatggacattgcttcaaaaccgagcgtcgacacttgatctgatctgcctcttaaacctctttgaacgtctcctccctaatctgtgatggcagaatggtaatacttattttgaagttgtgtcaggattggtagcagcgtgcagagattacagcatgtattatgaactcataaataacattgcctggggtgttattttcattaacttcatcatcatcatcatcatcaaatataatccattgcttcaaagaatttatagtctagtaagggataaaaagattgtgtgtttgtattaaagatggggtggaattcttattaagtatcaatttcattgccaacatggacatggcaaatgacaggttcccccaaaaattattgagggaaactgagattagatattgaggagattttgggacaccaaaaccaaggcaaatgaagcactaaggcactcgacaaaatgagacacccatgaatgtccagaggtatcacctcagaagttggtctgaggggcaattacacaagcagagctgagcagaaacagtggcaatgaggggtgagtgcagccaaccaggaaacctgccgtcaattgtgttttattcttggcaaggccttatttgaagttttctttcttgattttgttcttccccgctactgctagccacatctgacagatacactaatatacgaaaaattaaataacaataaaaataactttataagacgtgcctcaaggcagaatgaatatcaagtaccagatgatgatggaaagaattctgctggagttcagtggacacagctgtcttatggcctgaggtgtaaggatgacactatgagaaagggagccttgacttcacttttgaagaagtgtgcagggagcacgctgggaaaaggagggctggaaaagagatgagatcttgctggatcaactgaagcacctgccacctgcttggcaggacaggaaatcttaaagtcaatgctcctcacccttagcaccctgcaaccaaaaagaaaattcgaagggttcctcactctatttgattggagttttgaagaatctgtggcatcgattcctggtgctttgctgcccaggcacccctaatcttagcccccaccactagggggcctccctctagtctccttccttctaagcattgatcacagcccactcaggtttaataagcatgactatccatgtctaaaaaaaaaatgatactttatgacatcaatttgttgtgaacttttcaagcttttcttcccaaatagcatatggatattcaatttggaaaattttgatataggtttaaacaaaatcaaattcaaataatctgtaattatgccaaccccagaaagctaatgcttttgcttatttttagatatacttccaaatttataatattatgaatagtagtacacgtcagtaagtacacatcttatttcacaaaacatgggctcacatttttctaattcatcttattcacttaatgttttgtgaacatttttccttgttatacatctacttcagtaacattttttacaatctgaacagaaattaattgtatagaacagaacaggattcctttgttcatttttatatatgtttcttctaatgtttttctcataacctaatatgaaagtgataggttgtggctacatgtttacttatattcataataacattttaggatatattttgccagaatgtattttatggtcaaatggtatttacattttaagtctttttggtatgtatttgcaaattgattttaaaatattgatattgatttatgtgaaatgggaatgtttgagagtgccccttcttggattcttagccaatactgaggcttgttataataaataaataaataaacaaataaaagccttttctcccactttgatgggagaaaaatgggattccatcatattgtcatgctaatctccactaattataattgctaattgtattatttatttgtatattcttgattgtgatttgtttgcttataatatttgcctaatcctggaggtatttatacttcattatcttattttagatagttcttaatatgtattaataatagtaactccatctctgaaagaaatgccaagtagttttgcttcacatagtctgtctgcttaatatctatctggatttttccccaagtcaaacctcttagtcttttcttttatggtttttaacttgttaagtaagactttcctcaattccaattattgaaatatctatctatctgtctacatttatgcctactatgtttatgattggattttttatttgtaagatttaatgtttcttaggttatttttgatgagaataaaggatccagtgtgtaattttgactgcttgtacatatttagtctgttttgttgttctggccattcctttttagtagcaagcactataacattcagggaaattttcaataactagtaatgcacatcttaaaaatgttctgactgttttcacttcttatgaaatttagacttatttgttggaactccaatacaatttctagtgaaactatgaatggaaatgacatttatgttaatttgagaagtaggttctttgcaatatcattttttatcctatagcaacatttgtctctctattcaagccttcttttctgtccttttgtggaaatgttatggttcccttcatataataaggtcttatacagtatattcccaagtgtttgcattttatccttgtctcatttcttgatttaaatggaatgccccaggtattatactatccagtttaaatgcccactattgctatttagacattttaaattaggaatcaatgttgaaatagttaacgactttttttgtcatctcatcatttgttaaaaaattttttgacttagttatattaggggttaaatttagaatcccttatattggcactaacttgatcgttttttaacaaatcctcctatgataatgttttgtattattacatgacttttttgaataacacaagtgcagttttgttacatagatattttgctcagtagtagcttttagtgtaaccatcacttgaatagtatacattgtaccacttaagtaatttctcattccttacaccctcacatccttccacccttccaagtttctaatgtctattattccacactctatgtgcatatgtacatattatttagctcctacttatagtgtgaacatgcagtatttgacttttcgtttctgagttatttcacttaagagaatggcctccagtttatctccattgctgcccaaaacaagacattgatttaataattaggatttcagatttacattcatataaaaatttgtctttagttttttcttttcctgtctttcggggggtcaggtgtgggcatcagttgatgctagattcttgatttgtaaagcattccatccttttcagtgctccagagagaaaatatttgaaagaatttacgtgtgagctgggtttggaatgattgttcttaaaaatatttttaaatgtcccaaatatttgctgacagatttatagaatgtctaggatttgcttaaaaagagcctcaggaacagcatggagggaggatctgtgggagtattataaaactctgagtatatgggctggttccttgtacattgttttgcttttatacatgtttgacatattcaaaaaagtttctaaaaatgaaatcacctgcaaaatgttttcagtggtggttacagattttctaatgcctctagtaattttggtaatttacatattattaggaaataatgagagtttaatattcttaaacatgtgtttttatcaagtctcctgtgtctaatatagtgcatttctgttttatctcttaatgagattagaatttcactttaaaatcatctttctaactcacaactctgatcagactacctacctgtgggcaactgctttacttactcaatcgaatttggaatgcggtggcgcgatctcggctcactgcaagctccgcctcccgggttcacgccattctcctgcctcagcctcccgagtagctgggactacaggcgcccgccaccgcgcccggctaattttttgtatttttagtagagacggggtttcatcgtgttagccagaatggtctcgatctcctgacctggtgatccgcccgcctcggcctcccaacgtgctgggattacaggcgtgagccaccgcgcccggccgaatttggaatttcttgtggggtaggcaacaaagccttcatgcgctgactccaggtgcctctcaaacctgagccccagctttgttttctcctccattttcccacactcctaagagacacttggaaattcttcctcctcagcctggggtgctgtcagctgtaaaacagtgtccatcttctccaagacccccggagaatgctgtttctcttaagccttccacaaattcccccttgttttatcttctgtcccttctctgaaccacataatgttttgttcagactgtggtatagccttaattgtactgtatgacgtttgcatgtttggaaacccaccttgttcttttttccacctactctgctagcagaggcctttgccctcaggtggcatggggagaatatttatagggtgagcatgtagaaacaggctgcgtatgtgccttaggccagcagtcttgttgtatgtctgcagcactgaaataggtgctcgttaaatgtttgtaggatgaatgctgagtgaatgcagtggacaggatacaggcaggtgattgggagcccagtaggactgaccccggtgggattagtagagagaagtagtgggagataacttggggtcatgttgtcattcacagtttgtggatgggagcaggtagggctggtggtgactataggaggcacagaacacgtacacagctcttgctcttcagaggttaccacaacaatgtgtatcttttccaactcataattagtagaaatgatgtttgtattaaggtaacagaaatatgctcctaaagtactttctcattatatccaaatcactttatcatcatttgttttactgtagttacaccacaatgtaaataaaagcatttagaaagacagttgtctgaacttcaaagctgtttacatagaggacatttgctagactgggcttttcctccatgtacccttgggtgagcttgtggtcttccccctaaagatcacaggctattttacaagttttcttgtgagctgttcagctttcttataagcatgagttacaccagggagttcatttgggtggacagagtccagaaatgtcctgtttcgactggtttgtttaagatggccatcaacatgtgaggtagggaatgtggactttctattatggggctttttaagactctagaccatcgttcgaattaatttcgttagccaaagttttaggccttttgtccagtgtgctcatttgcttcttggtttgctggtattattcagatcaaagaaggtcggtcactggaggaaaatggccagcatccataacaatgtgtacagttactgttgtttaattgagtggatttcctgtttgataattactattctgtagttcttgtgtgtgttttgaggatgagggaggagggacatatatgacatttgtatatttgcaggtgaaagagaaaaaaaaggcctaaagaaggggaataattaaatatgcttttagattgtcaagcttcctttcagtcctatgctctgtgtgtttgattcaaagctatttagagaaagtcatcatttgacccctgtgagatttcttccctgttgtgcttcaggtctcaaagagcttccccagataaattacaggccattaattgttaccaccaattatactggcagacatcaaaatgattttattaaagagctgtccaaagatgtaaaagcctatcttgacaagcatgcagccatgggcagtgtaatcactcgggaggcatgatatagagggaattgaggcacatgtggaacctttggtctagtctgactttcatcactttgtgcaacagaatatagaattgggaaactccatctaggaagcagaattctgatcacctgtatacagttccaaagcaagggtttgaattaatcatttctgcatttccaagacctaacatggcatgatgtggaagcaatagatatgtatggacttggatctaattctgaataattgattataattatcatactccagggaaatttgtaagggctgccacactgaggttgtgcttgcaaatatgaagtgcaaattggaattaattatcctggtcttttttagggaaatactttcttttgtcaatccagatgagtgatgaaaaagtaccttctggatttgaattagctggataattcttgactttgctcaagctttaaactggtaggagctttaatggctattaattagtgtgaaagctttttattttctgaaaaaactttttttttaaaaaaaaaagagaaatccatcttgattgacagatggattcctctgttttatgttttattgtttttgaagaaaggaactttgatttcctgccagggagctttcataaaaggaccttagcatgctgagccctgattaaacatcagggagacatgatgattcttttgtatagctctcccctcaaaggtgaagaggcctaaattacagtgactgtaagagaggtatctgctgaaggaccatgttcagctataggaaaaattggccgtggcatagacagcagtaagattgggatgcgaatgtaattttcctctatcttatgaatatttaaagaaaatttgtagaagcaagggccatattgctactttatttatttatttatttattatttttgagatggagtctaactttgtttcccaggctggagtgcagtggcacaatctcggctcactgcaacctctgcctcctgggttcaagtgaatctcctgcctcagtctccggagtagctgggattacaggcacccgcaaccatagccagatactttttttttgtatttttagtagagacaggttttcaccatttggtcagattggtcttgaactcctgacgtcaagtaatacatccgccttggcctcccaaattgctgggattataggtgtgagccaccatgcccagcccataatgctactttagagaagagaatatccggttaagctagagagtgatatagagaatttacccacataactgaaaactttttataagataaaatagaatttaatttttatttttttttaaggatcctgctaattttagcagattttatttatgccacatgacaagtgtttgtgtaattaaacagctcactttgttctgagtttactatgtttgcttcccaatcttttattgtggaagtcctacttattaaccctgccttcccaaatcagttatgaagataaaggtgtaaactaaaaaacaaagctggtttatgagcaaggttgagtaccagaaggaatggagttccctaaattataagagtttaatctccagttttaatccgtagatgtaccctgactgccacttattagtcacgtggccttgggcaaggttttaactactctgaatctcagtaaaagtatataaatgagataataatatttacccggaagaggggttgtgacaactcagtaagataaagtgcataaagggccgagcatgctctggattttatggcattgcgtgtggcgacagtattgtaatgtaatgacttaaaaataaaactaaccaaggagattctaatcgatgattggatcattgtgctccctgttaggccaagagataaaaataaattactagagaatttttgggtcaatggcaattcttcttttagcaagtataagatgaatatgatcatatatcctttacttacttttggcttgacacaaaacatatgcctaagctgatcaagaattgcttagaaagtaaacgccaaattattttttctgtttctctttttttcttgccttcataaactgaattattaatatcctatctgctgtaatttttattttctgtgtaaaggagaatggtcgtagtctaaatatccacctctgagaacttaaaggtgggtcaaatgttctaaaattacaacacctttgctaaaatgtcaattctgactattaaaagtgaatattaactatgttgagatcaacttaatatgctaaaaatgaactatatttgggttgctattaattaatgagaaatagaacaaattaagttcaagaacattaaaaatctacccaactttacatatttatttacttagtcattatttatttattttaaatgatagactttgtgtcttcgatttacaaaaaaattgattgggaagttcagaggttccataaactccctctcacccttgcctttagtttcccctaattaacgtcttgcattgataatactgtaaaccaaaaacaaaattctaagcccctcaactgactgatggaccccctcttggccatgagtattccaaagtaaacttgaaaagggagttcaagccaggatgcgaagaggggtccagtgtgcctcattatactctcctctctttggaactcagacacaactgatcagcattaaagttaaaacagagatcttaagactgagaaaacagattccttgtagcaataagataccaaattccaacctaataataataaatctaagtgacttttattataaataataaattggtttttacatatggattcatagttgtcaccaaatcaatacatctttacaagtaaatcacagcttgggttcaaacagattcaactgcaaatcttaaagaaatatattgacctcataataagctaaactgtacttattctcacttaaccactttgtgaaacagtttatctgctggttatttttaaaggaagtaacatattatgtagcatctacagtttaatgatgtacattctagagcatttgtccttaaccccagcagcaggttaccaccacttggaaagctttttaccagaatatccagagcctgtctcccctgcagggattctgattgaaagagtcactccacctccctcctctttctcaggtagtgcggagtttccccaggtgattgcaatgtagacccagcattaggaccaactacatttgggtcttaaaaacctcaaaactgattgaagccaagagatattaaaacaaattatttgaaatagctgtataaaaatccatcataaagaattgagtgctttattttaaaacataaaagctcatggcttatcaaatattgttcccaaattataaaaacatgaagcaaatataggaataacatgaaactgccctccctgccctacccttatgggtacatgggtacattccatgcagtagcaaaaatgtataaatatcctaaatgtccaccaatagagaagtgattgaataggtgtcatgtataatcataataagagccgtaatagtattttaaaaggtttaaattttaaatatatctctatgtactgaaatgaattataaacattatcagttagaaagtaataagacaagttaaagaacaatttttttttgagagtttagctctgtcaccaggctggagtgaagtggaatgatcatggctcactgcaacctggccctccagggcccaagtgatcctcccacctgagccttccaagtagctggggccacagtcacacactaccatgcctagctaatttttaaatttatttgatttgtagagacaaagtcttgctatgttgcccagtctgtcttgaacttctgggcacgcgcagttctcccaccttgacctcccaaagtgttgggattacaggtgtgagccaccacagggctgagtcacttttttttaaattgacttttctgtcaagcagagtggcctacgtcatgacatggaaaatttagtcaattatggtgaacaacctaataaatatttaattttgtgtgcagacaacctccctctccatctgttcttctcctcctcaatgtttctaaaatccctgcaataccaatctaacaaaagttggattcctctcaaatggaccttgatcatgtgcctaagaattaaaacataataatcctttgagaaacatctatgaaagatgcagtatgaaatgttgagaagtgagtttgtagcttccataccatgcttcggttgaatttcatttccaaatacccagcggccgttttgcatggtgtagctgggctatggagcccaggctcctcatgatgggttgggtgactgaaacacatttttttcttttaggtgataaccagctccttcatcaggcttctctttcccaagtttaggaagaagttgactacaatgtatttccctagcatgcctgttcccttgaacaaaggcaggttcaggagtgtagtgaagctccaggctccaaaaactctttcactctcattgcactctatccaatgtttcttaatgctaggcacagcagaatcacctcagtttattcctcaaaaatgatggttgaatttatctggccaggcattggtagtttacagaagtctaccagatgattctaatgtgtggtcaagactgagaactatgtgtttaattgggttcatttcaagaatactgtaaaaattttatctaaatactaaatatccataaaagaaacctcggtaatcaggccaggtttttgagtttttccagattagcccaactacaggggaaagagactttcgcactatatcccagagtctctgctcctgcttccagcctcaatgcactgggcctttctgctgccttggagcacttagagggattacaggaggagtgatctgtggagttttatctgctgtagacaggacctctcagtgatgcatgcagtcactgcccagggtgcagctggggaagtcacataccgtttcaactcaaactggtacactgcaattcagttctcataaccatctggagttagtgcagaccccataagttaaagagtatggtctccagcaagatggtcctcgcttcatactcagaggctgcaaatccctgagcttcccatgacgttcctgaagctcaaaaattcactagaatgacacagaattcaggaaagcattatacttacagttttattgtagaagatacaactcaggagcagctgaatgaagagacacacagggcagtttctgagagggtctcaaacagagcttttgtgctctcttcttgtagaataagggcttgtcactattacctggaaaaaaaaaaaaagaaaaaggaaacaaaaagacaaaaaacttggttcatttgcctggcaagtaacaaacgactctccaggagaacataggttttgatctataggagttttattacttgtcccaaggtaggagaacaccgggaatattctccaaagcagtgtctccccgaggaaaagtgacaggtgggttttatggagttgtggagaggggagaaggtgcatcatcgcatgtagaggaggggcaccagtggtgcagactgagacattatgccagcacataggttacatgttatggtgatgaatctgtagctcctcccagcgtagagactttagcatggtaatgaggaagcttcactcagattcatctataagttgctggggtctgtctggaactggttccagctgactaggtgactgcattccatggacggtttgtaaaaaacaggctgaaaagtgggaggctataaaacaggctgattgttcaagctggttaaacttctatagtccctggagaccctccctgtctgcttacatcactttcctggcacattgatgtattcaccaagcgggaagtttcagcaaacttccctgttcattacatagatgtaattgattaaacattggccccattattgaactcaagctccaactccctcacttttctggaggtcaggctggttcagagctttaactctctaattacatgttaggtctttctgttgaccagcttccattctcagtcatctcatctcatgagcataaactcaaaagtttgatccaagggatcatgaatatcaaagactcttctattacctgggaaattccaaggatatagattctgtcttccaggaaccaggttcaaaggccagttaaattctttattatgcaacaaaagatttccctgaaaccagacttagaagtcttgaaagagatgggggattcaatttccacacaatccctgggctctagaacaaaggctgtcatcactgtcctcccctggtccaccattttgggttgtggtccctctctctccttgggaactttttcaagaatcagtattcagtcttccaggggctcttcattttacttctataccttgagatttatcacctgacggtgcctattcttggatttccacacccacactctttttactattcattctctaaaagcccaactaaacaaaacacaatcagatgaacctcatcgttcccccttttcccaatagtacttaattgcccattaacaggagatgaagtttcggaagatactcactcccattcttagagagaaggaagtgtttattctgcatgcacttttaagaaaccaggcagaaagcttttttgtttcattgttcaggagagattatgactaaaaacaatgccattacatctcccattaaaaagagtctgaactctgggcaattcaggataaggcacgtgtataagccattcttgtgttgctataaagaaatacctgagactggctaatttataaataaaagagacttaattggctcatagttctgcaggttttatagaaagctggatgctgatatctcttggcttctgtggaggtctcaggaagctaacagtcatggtggaaggaggtgaagcaggagcaaacacgtcagatggtgaaagcaggagagagagattgagagagaggagagagagagagaggagagagagattgagagaaagagagagagagagagattgagagagaggagagagaggagagagagagagagaggaagtgccatacactttttaatgaccagatcttgtgagaactcacgtcatgaagacagcaccaagccatgagtgacccacctccatgatccacacacctccaccaggttctgccccccagcattggggatttcaattctacatgaggtttagctggggacaaatatcccaactatatcagcatgtaatctactgcttgacataggtaagaagtaattcttcacaattatttcaaaaccatttctgaatttactttggaatctaaagttaatttggaacaatatattttatcaaattagctccaaagcgatatttactcatgcatcatccctctgaaatgtactctgcaggttgtatgttgtacaatcttaagtatttcaattacctttaagcaaaaacagtacaagaaaggattagtcattgctgaaaatattatagatcacatagattcatttccagttttcagtgttgttttttaagatagtaggtgtttgatagcttctagtcaccgtccaaagggtcatggtctttctgatctttttgttcagaaatttgttctttctggtcaggcacggtggctcatgcctgtaatcccagcactttgggaggccaaggcgggtgaatcacaaggtgaggagttcaagaccagcctggccaagatggtgaaaccccatctctactaaaagtacaagaaagttagccaggcgtgatggtgggcacctgtaatcccagctacttgggaggctgaggcagagaattgcttgaacccgggaggcagaggttgcagtgagctgagatcgtgccactgcactccagcctgggcaacagagcaacgctccatctcaaaaaaaaaaaaaaaaaagaaaagaaaaaaagaaatttgttctttctgatcacatatgactcaggatataatgaaagaggatcaagcctctaagaagggtggactgaagctagcacaacaatatgcctgctatatgaccatggcagacttcttcctagaatccttcagatccacgatcttatctaattatgtataattcccacagcagctctgcaagatagatacttatgtcccaattttgtagatcagaaaattgaagttaaggagatatgttcattaatgaataagatggtaagtagtagacataggattcaattattattattattttattattatactttaagttttagggtacatgtgcacatcgtgcaggtttgttacatatgtgtatacatgtgccatgttggtgtgttgcacccattaactcatcatttagcattaggtatatcacttaatgctagggattcaattattttgataattcaagtttcttccaaagtgtcctatgagtaattgtttctacggtactctatacaacatatactttcaggcacctcttctcagttggtaagtttgtaaagtgttttcctgattggtacaagatgaaagtgtatgcccagcaggttattaaaggtaagctaactataagagtcattcattcagtatattttttatagagtagcctgtatttctgctacaaatgatgttggcatatatgaattacactcattgttttttctatttaataaacactgaattatgttattctacaataatggcatggtgaagatggttaaaagtagtgacagaaaaatttgactttttagaagcctctaatttgtgaaattaaaggaatgatttcttctaccatgaggtcatagatattgaaaaccatttggatattgtttaaaccagtttaattttatataatttatttcatgagctttcaagtccgtatctccaatgatcataccagacagatccccaattcagaagttatcttgcctctgacagtgcttacaacaactaataaccaggttcaatgacagtgatccagtttcggcaggtactataattgcagattatactgttcatggtttcttctttgtgtgaatagtaagtgtatgaaatcttcagtcaacatttccttttctgttgcataaacagtgctgaaagcttaatgatcagctggagaagaggcgtaatgaatagttgcagcattgttcattaaacaccgtggtggttctttctttgccatcatttcatctgtgcttgaattttgcatttccttctattctgtcattctccttaagcatcggacactccctccgtggtaattgctgtgacacacataaagcttctatcatacaacaatggaaatgtctctccttctccttgagctcattttattggagacactgtacttttgaggatggcaaatctatggaaagtgactcatccaagcatactgtaatagatggagagatttctttagatatatgtggccttttgtacaattaagcactgtattgcttttcagtaaattaagagtaaaattttaagtaaattgggtttggaattgggatttgcaattttttgctataatttattttagatcacctattacttttttggtaattttgtttctactcttacataccttgtgttctacatattgacaaatcatgctctatttgatgaattacatctttaagttattggtatgttactataggtaatgtttttgtatcatcttcagtagcctgttagcatattatgacaacatgctattcctatctccccagggccaagcctcaattaactgctgacactaagaggccttcactccagaagtagattccaaaacacatgttgcaatgaatagaactactttgtatttcacccaaaacatttaagccatggctgtttattacattgtgttattttattcatggattaaagctttggaatttggtaaaggaaaagattcccagagactgctattgaaatttcctagtaccctttggtttaaagtgtagaggaacaattttccagataaatatggaattcgcttttttatgttgttctttagagagctttagcctatttggcactaagtataattatctgcaaatatgagtttgtttggcaagatattcatgtgtccttaggtattaatatgtcattttggggaaaaaataactcaatggagttctgtcattatatgaataatttgtgatgagtaatttcctaagcaacatcagaagcaccagatgacgatttttgtttttagtttgcaaaatgcatttattgtataaggatgaaaggtaagtaaggaaaagataggttttagtagctgagaaactttagagtcaggttatacttaggtggatttaattgccatactttgttatagtggctaaagtagcccatttgtcatctgtgacctatttcagggaacaacaacaacaacaacaacaaagaaactgtggataacatcaccccctccccacctttgttgttcttcttgatgcctatttgacagaaggattgagcactttctgtttctgttgcatgggccactctctctgagacttctcccacagtattcatatccctgcttcaggaccacctcctctgaggagccttcctgaccaacctgtataaccctttgttacacaaccctttgttcctccttggagtcactttcactgtccagcttctcaatttacccagctttttttcattatacttttcagtgcctgaacacacacacacacacacacacacacacacacacacacacacacacacagtttcctgtgttaaaatggttaaaatgtcagctctctggggggaaggaactggtttgtcttacccagtgttatgtccccaattgcacagcagtggcgtgtttcagttatggtcctgcctgtgttcaccatgtaagtgggcagacatgatagaaggagatctattatacttccttgtgttatgtgcctatggaatagagggaacagtggagaaagtgaataattatacctgggacctggggaaaaaactgaaatgagaactgacatgttaatatatgtcaaaagattgagaagaggctggggagaaatataagaaaggagaatttcactcggagtaacttggataaaatctctgagtttgaaaagagtatggaacattcaagaaacagtgaaccaaactgtgattggagttctattcccaacagttgcataagggaaactgaaatgaggtgggtctggagaggtagcttagaattaggttttgaaggagtctctgtaggttactaagcatgatcagcttggtgttttatgactgtattctgataactgtgaaagatggatgggagggaagcaggaaaggggtcaggaagtagacagtgtaagtgaggatggttgtgtgtacagaagtgagtgggagaaccacagatggctcacaagagaacatgtgagagagaccctgtgtcagctacagtttgtattagttggttgattagggatattattttggttttgctccgtaaggtggttggggccgaagctctttctaactcaccaccctgctatagtcagggtatgggccttgctgtcatggtccaaaatggtgattagtgctttaccctccacatctgttctaggcagcatgagggtagggtccaaaagatgaggggaggggaagccatgtgtaaattgtgtttaaaaaattattataaaaaacacataaaaaattaatcatcatgtcatgtgtacagtacactaatgttgactctatgcacattgttgtgcaacagatctctacaacttttccatcttttgcagaactgaacctcagttccctttgaaaagttagactactttagataactcacaaacatgaaatcgtgaaacatttgtctttctgtggctggcttatttcgcttcacataatgtcctcaaggttcatccatgttgtagcatataacaggattttcttcttttttaaggctgaacgaattctattgtatgcatagaaaacgtgttctttaaccattcatccacggatggacatttaggttgcttccacctcttggctattgtgagtaatgctgcagtgaacatgggtgtgcaaatgtctccttgaggtcctgttttcagttcttttgaatatatactcaggaatgggatagctagaggatatgggtaatttatttattttttttgaagaacctccgtatgtttccatagcagctacaccattttacattcacaacagtgcacaagggttccaatttctccacattcttaccaacatttattattattattatttttaataatggccatgatatctcattgtggttttgatttgcatttctctaaagattagtgatgttgataatcttttaatatgcttgtgggccatttggatatcttctttggaaaggtatttattcaagttgtttgcacattttttatggagttattttgttgttgttgagttgtaggagttctttatatgttctggatattaaccctttattagatatatgatttgcaaatatcttctctcatcctctaggttgcctttcactgtgttgactgctttcctgtgcagaagttttcaagtttgatgtaatcccatttgtctgttttactattgctgcctgtgcttttggtgtgatagccaagaaatatcgccaaatctaatgttataaagcttctcccctgattcatccagtagttttatagtttctgggcttatgttaaagaccttaacccatttttaactaatttttatatatgatgtaaggctagagtccaactttgttcttttccatgtgggtatccagttttcctgataccatttgttgaagagacagtcctttccctgttgtgtagtcttgacactcttgttgaatatcatttggtcataagacctgagagtttatttctgggctgtttcattctactgctctgtatgtctttctttatgccagtactgttttgattagtgtagcctggtaatatgttttgaaatcaggaatcatgaggcttgcagctttgcttttctttctttgttttggctattcaggattcttttagatgtcataagaattttgaaattaaaaaaaaaatttctgcaaaatgccatttggattttgaaagggatttcaatgaatcagatctctttgggtagtatagacattttaacaatattaagtcttacaatccatggccatgggatatcatgccatttatttgtgtgtgtgtgtgtttttttttttccagcaatgtcttatagctttcagtgtacaaatttttgcctccctggttaagtttcttttcaagtattttattctccttgatgatattgtaaatggaattgttttcttaattttcttttttgtttgttcattgttagtgtgtagaaacacagacaattttttaatgttgattttgtacgctgcaactttgctgaattcgtttatgagttctgacagtgtgtgtgtgtgtgtgtgtgtgcatgcatgcatgcatgcaaaaattttaaggttttctacttataaaatcatgccatctgtgaacagagatcatttcacttcttccttttcacctgttggtgccttttagttgtttttcttgtctaattgctctggttaggacttccagtactatgctgaatagaagtggtgagagtgggtatccttgccttcttcctgatcataggggaaaagctttgaattttttcttgttgagtataatgttaactgtgaaattttcatatatagcctttaatatgctgggtaattttcttctattcctagtttgttgagcgtttttatcatgaaagggtacttaattttgtcaaattcttttactgtatccattgaggtgaccatgagattcattgtcctttattttactaatgtagcatatcccattgattgatttttcatatgttgaaccatccttgcatcccaaggatagacctcatttggtaatggtgtgtaatctttttaatgtgctgttgaattcagtttgctagtatttttttagggattttgaggatttttgcatcaatatttatcatagatattggtctatagttttattttatggtagtttctttgtcttgttttggtattagggtaaaaatggcctcataaagtaagtttgaatgtttcctcttcaagtttttagaagagtttgggaaaggctggtgttaattcttccttcagtgtttgccagaattctccagtgatgctgtttagtcttgggcttttgttgttgttgttaggagatttttttattactcattcaataatcttactagttatagagctgttcagattttcatattttcatgttcagtcttggtaagttgtatgtttctaggaatttatcactttcttctaggtttccccgttgctggtgtatgattagttatagcaatatcttattcatctcattatttctgtggcatcagttgtaatgcctcctctttcatttctggtttttgttatttgagtcttctctcttttttcttagtctagctaagggtgtgtcacttttgttgatcttattaaaaaaaaaaaacccaaatcttactcttgttgattttttcctattgtgtttctagtctctatttcatttatttctgctatgatctttattattttttcattctgctaactttgagtctagtttttcttcttctttttccagttccttgatgtataaagtcatgttgttgatttgattttttttatagaaatataggcattttactgttacaaacttcttttatattaatgcctttgctatatcccatggattttggtatgctgtgttttcattgtaatttgtctcaagatactttctaagttcttttatgatttatttttgactcattcattgttcaagaatgtattattttcatctatttgtgaattttccagttttccttttgctgtcgatttctagttttattacattatagtcagaaaaagatgcttaatattagttcagtcttcttaaatgtgttaagacttgttttgtgctataggatatgatttatcttggagagtgttttgcatatgcttgagaagaatgtgtattctgctcttattctgtggagacctctgtatatgtctcttgggtccagttggtttgcagtgttgttcacatcctttgtttccttatttatcttctctctgattattaatgagttgtcttttttgttttttagagtcagtttcactctatttcccaggctggggtacaatacataatcatagctcaatgcagccttgaactgctaggctcaaactatcctcctgccttagcctcctaggtagctgggactataagtgtatgccactatgctcagctgatggtttatttttatttttattttttgaggagatgggggtctcattatgttgtgcaggctcctagtcttgaactcctagcctcaagcaattctctcaccttggcctacatgagttgtcttttaaggagtgtttgcagaagctctttgcagtacattggctgaatctcattagctctctttggtcatgcttacatgcaaaaaggctggaaaatgtagtccaattccaggtatcgtgcacctctaaaaataaggattatattcagaaaaagtgaagaatagataatggggagcagactgcattgggtctaacatattagatcagaatctaatatttttaaggtaccgaatgtatatcctatcacatcttgatttggatgaggcttttcattttatagatggaggaaactctgaagccttcccttgtgtgtctgtgatatatgagcttttaacttctcatttatgaagttacaatagatatataattcttaccttattgtgtgttctctaagaagcacagtaaaaataaaatgaagctttaaaagtttaaaatgatactgcagggaattcaagatgaaaaagatatacaatgccaaattacttccacccatgttgttacataccctattaacagcatgcacaagagacaattctatttctagattttagcaccccatttcataatttttacttgtgacgaccagagaatatgaagtaggaagatggcctgtggggagatattatgcatttttgttattgaatctcaccactaaaaattgtgtttagtaatcacttctccatcacctaaaaattggtaacaggtaaaattgaaacaaatttcagtaagataattttgtcattgggtacctcacttgaaatgtgcatttctgagtggagaggaagatggatgattctaggcaatttatactaatttctacgtgtgcatctattaatttttgaagaaatactgttagcgaaaactgtaaatgtataaagtggttctgatcacagtggaggaatggaataaaaattaaattgaaagcctctcatgtcaggctaagagatcgttttaaaatcatcatgcttatttacaaaagctctgtgaaactggtctaagttaaagaagaaagaaaatgagttttagattagaagtgagttatggcccctgcttttcctagcagtatgtccagtttattcacagtgttctccgcagttctggggcattctggggaaatctgttcaggaataacccatgatatcttcttggggcttggagagagtggtaaacagacatactgtgggtcaaactttgggatatccatcctctttcaaccacagagttagacattgatttttacatattgaacttctgcattagcatttccctggaaaaataagtagttctgaggcaaaagaaacaaaccattggactaaatcatgctgcttttatctctcctccaacagaagactacattttagaagtcattttatcaaactttagatcttctcatccttttccttcccaccacctctttgtaggcctaaaatttcatgagttattcctatactttaaaatatatgcttggtaaaggaagatttatctttgagcaaatgaataattcagaggctagaatttccctgagattagtttacaaagtgaagactccaacccagaattcaaatttctagggcagaaaagatgtttgtgctgtttcctccacataacagaaatgcgactgcgttttagtgctcattgtgaacacgttcttggaaaaaagaggtggaatgcaagtcccagcagaataggcacattgtatatgacagatgctacccgctttctgaaaagactcatagtcctcagtttttgatgtaagtaggactcattacatcaaatctctctttaagttttaaataaacataaagttgtttccaaaataatacaccccctctataattaggtggagaaaacaactgttatcagccgttgactacacaagatctatatcagtccttgatgccttccttgaaaattccatttttcttatacatgctttggattatcttaaaattagctagatttgttttacattgtgaagataaagatttctcaagtttcccaactctgttgagtcaacattgagccccttatctttcctcaattcactgatctagctgcaatttctcatgcaatttccaattttgtttatgccgtttgaggacctcacatataccaggtggactttcacattatactaacacataaggactacgaggacagcaataactgtatccagatagccaatgaatagtgaattcagctatgatataattatcaaaatataaatgtacaagtgattctttgattagtcttttgaggattaataacgaaagaacctagaaacattaatattaatcacattagtttttagaacattaaagttagagtcttctaaataagaacattttctaccggccagtttgtgttttctccctataacctctatttttgtgtcacataatttaccttatcacatggacatattttacactttacatctcttatttatttaaattacacaagtagtagttgcattaattgctgggcatggtggctcatgcctgtaatcctagcaactctggaggctgaggcaggaggattgcttgagagctcaagactagcctggacaacatagaaagaccatgtttctacaaacatgaaaaaaatagccaggtatggtgacacatgtctgtagtttcagttactcaggaggctgaggcaggaggactacttgtgcccaggactttgaggctgcagtgggctgtgatcttgccattgcactccatcctgggctactcttaaaaaataataataatttgacgcattaagtttttgggttgtatgtgccatctttaacaattcaggcttcccccttactaatcttgtggaaagcatctcctgaaataatctcttccaatttccgactaaaatggcattgaagagagaaaaagatgaaatcttgcaacttccatcccatttccattgcataccagcaggcagcctactgcctggatctgaaaggggatcaatgtaaagatactctgcctagattgtgaataaagcagaagtgacttaactttcataagacccataaagtagaccagtcacactgccccaagaaaggaagaaaaacatttcaggccattgttgtttgctgctggcctctgaggccaaaggcttcatcagctagaaaacaatgtatctcttaccattacaatcgtggtgctttatactgtagttaaggtacattcttccactgatgatttttttcttacatttactcacagcttccacctccaagaggaaagtggggggtgctctgaggaagcatgggaactacagatgacttaccacattgtgacaagtgtagtctccacagttttggggctgtgacagcaagaacgtgattgcaggtgcaggtgtgctgagatggttatgctccagtactgagagccataggacaggagagggaaggagaagcttctacccccgtttaacagagccacagtggatgagtgatttctgttcaccagacacgcctgtgacatctacctgtttttaacttcagacctgagaaggtgatttaacagtcactcaaatggcaagtaagcagacaaaaagaaatccacatggcatgcccaagggcaagcgtcagaagagacaacatagagctcataatatacaaagagcagcagtgcattatcaacctaaatgtttacagaaagagtatgcttctgatataccaacgataaactaaaataaaattttagaaagtcattgtatagctacaagagagttttaaaaattgcataatatgcagtgtctcaagaaatatgtcaccataacctttacttgaaagactaaaagaaaacttaatttgattttcagaaaaagagtggtgaataaaagtgttttaaaaactgaaaaattttagtatacatggggaaaatgttgtttgaaatggttaaacttaaagatattggttagaaatgtgattataaaactaaatgattggtataggttagtaagtgtcagggaaaggaaagtaaacaaaaggcaatgatatgcctcatcttttgtggcaggagtcaaaagatgcaattcatgctgaacctacataggctgaaaaacaaggctgatcttccgtgagtcagagggagtcaatttgaattataggatgaatgaaacttctacgtatcctgagctctaagtcacagatggaaattatcccttccagtaaagcacccatggcacattttcaaaaactggaaatctgtttaccacaagtactgtgatataaaggcaaaatccctcagtctggcatgatctagacctctggggtgtgacttatttttgcattttaaccctcaaccaccacttcccagcaccaaccatagttccatccagattccactgcccctgagctctaatggtgcccacccctgggatgatctcatttctacctcccccagacctccttccacatcctctgcagagaggccttttgtggctcacctacttctcagggctctttctcttcctgaatccttgttctggtcattgtctgaatatctcacttgtcacaactggattggaccttattttgtccattgttttgttttttttccatgacttggtgttaattcctagaaggtctggatcgtataatctttacttttcttcttccttattctcctcactccccttcctcctccttctttttccttcttttatctccttctttctccttcctcctcttactcctcctcctccttctaagtcttcccctgcgctaggctgtagctcactgttaatgcttggttcactgaatgaatgaaaacaagaaaagttgtaagagccttaaccataacactgagttacattttgtcttcctttccttgttttaaattgcgattttgcccataaatgcattctggaaattgagtcattggcatttcatagaacacataatatctttgctctgaaaacaaaagcaatcttatacttcaaatctttataaaagtagagttaactataaggccaccttttacatcttgatacagtaggggatggtgttttgggttgaattgtgtcctttcaaccccccaaatttatatattgaagtactaactcccagcacctcagaatgtgactttatttggaaatagggtcattgcaaatgtaattagtaaagatgaggtcatactggagtgggggagaccgctatttcaacatgactggtgtctttatataaaggagaaatttgtgcacagacgtgcactcagggagaatgccatgtgaggaaggaggcagaaatgagattgatgtatctataagccaggaaacaccaaagatttgcaggaaaccaccggaagctaggagagaggcatggacagatccttcagaatctctcagaacgaacctctcagaaagaaccaaccttgctgataccttgatcttctttttctgaggcggagtcttgctttgtcgtccaggctggagtgcaatggtgcagtcttggctctctgcaacctctgcctcctgggttcaagcaattctcctgcctcagcctcctgagtagctgggattacaggcacccgccactacgcccagctaaattttgtacttttagtagagacgaggtttgaccatgttggtcaggctggtttcaaactcctgacctcaggttatctacccacctcggcctcccaaagtgctgggattacaggcatacgcccagccaataccttgatcttaaacttccagactgcagaactgtgagataagtcctgctgtttaagccacctaagttgtggttctttttaatggcaaccctaggaaactaatatagatggtggttttattaagaaaaagaaaaataaaggcactcttatatttgtatgtttatattaattgccccggaaggctcttggcagcctcagaggttttatagcccaagtatttctgcagggaaggaagggacataccacatgatgaaaggtaagtttttggttttctgtaatctgattataagaaggttgtgtatgtgagtgtgtgtctatgtgtgtgtgttttaataagaataacatgtgcagctaaagccatgggattatgctcacaggttgctacactcatacaaaaatgaaaatattttatgaatacatgagctgtccatcatgggcgtgaatctgctgattaccatagtctctcatgctccgaacagacttcttcatgaattttgagttatgcttggaaaatatcttgcagttcaacaggccaaatataaaccacgggctcttgcttaggcacgggcctggtcttgcttagtatcgccatcttccaaaacctaatctgtaactgtactagcttcctagggatgctgtgacaaagcaccacaaactgggtggcttagaacaacagaaatgtattgtctcatcattctggaggctagcaccaaggtctggagtccaggcagggtatcagcagtgccatgctgtctctgaaactataggggaaggacactttttttgtctcttccagcttctggtagcctcagccagttcttggcttgtggtagcataattccagtcttggtctctgtctattcgcagtatccaccctgagtctcttcatgccgtcttctctctatgcatgtccctctgtgtccaaatttccccttttcataagaacactgtttatgtaggattgaagcccactccagcaacctcattttaattccatcagctctctaaagacctcatttccaaataagattgcattctaaggtactagggtcaagacttcaacttatctttttggaggtacacaattcaactcacaacagtaaccaaaatgacttttcaggctggtgcccagactgcctgtcatctgacagaattttcatgtatggctgttctggttgcaaatagcagggcctcactctccccattggccttgatcccattgctcatagtggcattctgacattcttacaatttgtataacctttgtgctatctaatttgacccgaaagccccagagtaggcatgttctatgagtatgttgggtttttttttttctagcaggtaacatttccagattagccgagccaaatgatatggtaacataatagatttccacctttgcacacctgaagtgtatgacctagtctaatcactgactgtggaaacagtagctaatatgacaaaagtgccgtcggggacttcagcacttcattatcgcagggatggcttccaaagctaaccccctcagtgagaaactcaggcatcccagattccaggagttttggaatagaaccccgtatttgtattgtgttggattgataatattaagaagtttacttaacttctccctctgagtgtgtttccattttaaaaataggagtgttaatgcctcctttgcagagtagagagtgctcaacacatggtaagtgctccttgtctgaaggttgcttattccactccctaatcatagtggctacaaaagatcatccttcagactcaagtaactgaagcctgtgggcattacatattcttgtactttttcttctattgtaaaatctgcaggacacttgaaagttgttgtttatgttgtttgtgttaaaacgcttatttttttaagatgatttttagattcacaacaacattgagggaaaagcgagatttcctatacagccccttcccctactcaggcatagcctcacccattatcaacattcctcaccagagtggttcatttgacttttaataatctccaaacccttagattccagaaaaaaatgcataggttgtatagtagggaagaaggtcatagtttatatttcttgagattatacactttctctctcaaaccaacggttctggccatgtgaggattttgtcactcccagctgatttggagatcatcacttttgcaatgcaatgtggaactcttgtctgcgtttagccctttctgaggacacattctgtgttttgctagactgaggcaagttcttgtgctttttgttgaaacaggcagtgctgtacagtgggaagatgctggaggtacaaaggaaaggccaggctgtgaatcctaacactagcactcgttaggcaagcaatttcacttttaccagcttcagttttctcaaagtgtgaagttagagggcaacctataggcccatcctcatttcccacactgattgcaaatttgtgggtctaatgcaaattgcaaatatgagaatcctcaaaactagccctaggttcgataatgcactaggaagaactcatagaatgtgctgaatgctgtaatactcacaggtacagtttattacagggaagtgttgcaggttaaaatcagccaagggtaaagggacatggggcagggtccaagaacatttccttgtggagcttctagttgtcctctccccagggagtatggacaactttacttttctggcaaaaacatgtgacaatacacatagggtattgtcaaccagagaagttcagtcaagccctggggtacagagattttactggggctccatcacattgacatagtcgaccacccacatggcagatctcaggctcctgtctctgagaaggctgagctgataccacatggctcaaagctctcaggctgaatcatactgttaggctcttcagtgtgacccaaggccctcaggtaaacaaagacgctcttattacatatgagaatcataagaaattacctccaggaagtcaaggactaaggccgtacctcttttggggcaaggttaataaattctttactacacacatagatagaacaagtgggtaatccttagcgacctgtctagtctgtaaaatctacagtgatgcaaatgtgcagccctgcttaagggcatagccaccgtcaccttgtttaggaactgtcagatctgccctctcatggccagatggctgcatcagcccactggtactctctgtgtgatatgcccgagggtttagggatgtttcagaaggctagttgtatctggcaaatgggtaactcttaattattgtatgacatttttttctgtatttaatggttaagatttagggaaggggcaatatgtgaaaaaaacacgttatgagaatgtttcacatttagaccttgagaaattggtatttatttatgccagttacctatgtctctgaggtgccaagaggatgaattaatattttatttcacttgtggagatattcagaaacattaaagtccttggtcctcatgagaaaagaattttcttgagacttgaaagcattactgcagacattttgctaacacattttttgtgagctgtgttaattgcacctacctttatcagtcagaagttttgctgatttaaatcagatcccagctaacccaagcggggctgcactgaaggccacatctctattgcccagatttcccaggggactctggaaattaaccagaagccctcctgctcgaagaccaactcttgaggcgtatatgatttgcatagaggttccaatgtgccaagttcttagaagtttctgggagccatacagatgattactattccaaatgttctcatcttgggttccaccctttttattcaatgagatttgacttttctactttttcactcccatcttcaccacaccaaaattcatatctaacagtcattgtgtatattatgaaagttggtctcaatttagtcaaacctgggtttcaggggatatagctcacataaaaaggaatgggaggtatcattatatggaaatacctgctgtgtgccagagcatcctttaaggtattttgttttctgtgatattttcaaaccctccactttacagatgaggaaagtcaggcccagagaggtcaagaaaatcacttcaggccaaacaaggtcacatggaaaagtagggattcctgtgaactcaccctgtgttcttcctactccttcatgctgcagaaactctccctgaatccaaatgatgccgctgctgaagtgtgggctggttagagtgcatcacacagagccaagcctcattgtacgggaaggtaaactgctgccttcagatggattttgtgtatctatggatatcatcagttgcccagcatttctgtgttatctgagaagtatttcattgtattactggcatgttcatggtgaataaaatggcaaaagtgttattaaattatattctttgctgtcccccaacacagctataaaaggcaacgctttatggaaagaatgatacattcaaaattcagtattcatcttttgctaacattttcctggtttgtgtgtgtttttatttgaatacatattattagtcaatgtagccataaactgaaaacctttgtgtttgaatttttgtaaattgcaatcttgcccttgagaaaaaaaaaatttaaaaatgctatttatgcttgttactactaattagggtggacacaaaacaatcgaatatctggatttgaccattggagggttacagattggttagaacatcagcatttatcatatttagatgactgattcatttgcagccagtcatgtggctgctgaaattttcccttaagtcaacgtttctgatctccatatgtaggagagtcgtaccaccgttcaaattggcattgatcaggaagggccaagagaattttcttcttctctttctgaagtggttttctcaggcaggactgagagaagcttcaacagttgaacagctgttgtctgtcctttttcctctctgtaaaatatttcctgatttgcactgatttcccttcctgagacttgaaacagcaaaacagaaacaaattaggtgtgtatcaggaatgaaatacctcctgtttattgagagtttaataataatctttgcaattagcgtttgacatcctggaaactcctactgctgagcttatacacacacacagaattttcaaacccaatgtggccaacacccccacagacacctggagaattcaactgctcctagaaaaagtggattggaattattttattcctttgcaaactttttgttgatctctaacctattggggtccaagcatgaaatggctctgttgtattcaacttctgacacttaccctccttaaattggtcaggaagccccttttgtgacgtcttggataaattttaaaactttttgttacagttgcttattttaagtcatgccaggtcagcaatcccattactgggtatatacccaaaggattataaatcatgctgctataaagacacatgcacacatatgtttactgcggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcacaaggacaaaaaaccaaacaccgcatgttctccctcacaggtgggaattgaacatcacacaccggggcctgttgtggggtgggggaaggggggagggatagcattaggagatatacctaatgttaaatgacgagttactgggtgcagcacaccaacgtggcacatgtatgcatatgtaactaacctgcacgttgtgcacatgtaccctaaaacttaaagtataataataataaagagtcatgccacttattatgccttagtccggtccactaaaacaaacacaaagtttagttcttccttttcctttcctcaacctgaccaaatttgtggtgatttcacttatactattgaagtgtgcttgtgtgtgtgtgtatgtgtgcgtgtgagagagagggaggggagagagaaagaaggcggcaggggggtgcggagagagagagagacctcttttttaccccatgagtagagtaaggagaaagtagaagaaaacaggcatctccctgcttatgcaagacttgtttcagataactggtcacccaaatggtggtctcagcctcagaagttggcaccccagttagttcattcctgggtttttttgtttttcagtgacacagggcacttttttctacctgtgttggagtagagtgtcacaataatagctgaatggagccttgaactcctggcttaagcgatccttccacctcagcctcctgagtacttgggactaaaggtgtgcataccctgcctggctatttttttttaaatttttatttttgtagagaagagatcttgctatgttgcccagggtggtctaaaactcctggtctcaagtgatcctcctgacttgggattacaggcatgatgcaccacgcttggcctcaatcctgtttaactgacctcattggacacttggccgttaacttctggctggccaggctaatgcttctctgagctgtttgtctctctggcctcatctgcagcaggccctgcaagttggtcacctgcaatttcatctgccatccatagcactgactctggatcttgacaggggacttaggggctcacatttattttctcccctcctcttgcctgtactgccaggtcatttctctctaacactcttcctgaattccagtagcaaaggtctgtgatcctgtggctaggtagatacccacaatagaactagctgtttgtctccattcttgaagatcctcccaaacttcacaagtctgttggttgagagccccatcctttgcttgggatgagaaacctatggagaggggtatgccccttgaggtgatttctgtttgtctttccatccttctcttgatggctattatctcagtggaaatagacctaacaccccagagaatcttataacttggttctcagcagggctctgtctttcctgtaattactgtgtatttgattatctctggggctctgaaaagacctcagtctgtaccttccagtccattctgatacattcttgtgaatcaccaagtccatctctttttctatgttggttagtaacccaagaaaataggagattgataaagtatcacattacagaacatttaaatagtatcatagactccattgcctttcttcccagaatgtgagtcattgcctttgtgatgttatgacatagtttatagcaaacataaaatggcactgtttaattctgctctagtggtcatcaggatctgaaaataaaacatatcaccagagtttttgatgactccagtctcaaattttcagtttctttgatttttctaaaatgaaagcagaactttttcatcctgtctttgtttatggcttatgttgtctaagcaggaagatactgactcattaacatctcaacatttttggtagaactgtaaagagcttttcaactttttaatctgaatattgggaagtcagatatattgaattagacttaaaattgggtagtgattattgttcatttcagtattttccaatcaagctgacagttatgaaattctaaatcaatatatttgctttatcttttatatctttaaaaatagttaggcaggtatacaagagttggggtatttctatatatttaaatatttttaaaaataaagcatggaacattttgaattcattgtggatgagggggctgatgagagttgaggtggtaagagcagagttaatttaggaagcagccctgttgtggatgggaaatgtttgctgctaatgtctatttttctgtgctggagctgacagaaatttcctttttgtttatcactttgagccttttgaatactggcagtcatgacacttatgaaaatgtatactatatagttaatgtccttttttaatctcatggaagtgaagttattttctttctttgattgcatgcaatggatgcttctaaaaatcactctctagtgattcaaatattagattaacataccagtttgctgagtaaattctctgaactctatcagaacaaagaagaaactacaagaaaacaagctgaactcaagagcttgctttctctctctctctattttttcttttggaccccacaatttccagctatgtcttagggaatcagctccaaatcagtctgctgctaaaatgatcattgtgtacacccagaataaaacataaaaatatctgcattcacaaaaggaggggtgggtgtgaatgagggcattctaaaaaagggtttaggcattgtagacatttgttctagacaggttgttaaaaatcaacatgaatgccaaaatccaggaaaagaggaaagagcacttcacaagcagtcctgctcatatcaccttgcctgtgtcacaccagccactgctgcactgtaaccactagcagttttaagggcctcactttcacctaggattttgcatagcattgactgtcttgatatgatttcacatgttatttatgtcaggattcagattactgaactggcatgagttgtgctcatgaaaaaatataactaaagtctgtattagtgttcttcagagaaacaacatatatgtatgttctgttacattatatatatatgtagatacagatatatacctgttataaaatatatgtttgttctgttatattagacatatacctgttatataatatatatgttatatagaatatataatatatataatactatatatattatatatatatacacacacacatacagagagtgagagattttatcataaggaatttgttcaagcaattgtggaagctggatctggttaagtccaaagtatgaagacccctatttcccagttgaaatctgagggctggaagctctgtagaacaggagctgatgtcccagtttgaaggccatcagacaggaggagctgatgttcctctgggaggccaagttgtgcaccacttttgcagaaataccagtggccatttattttagttctgcatttcatagccttgtcaatgatgaggactgattgggatctgtatccagctaagggtgattatgagaattcaatcaaatgtcctgtcaatcttgacctgtggcaaatgggcttaaaaatcatgttcactagatttcattacagcatcttattctttaaatatattcaagtacctacttagtagctgaagaacaggctggaaagtgaaaatcacagcaaaataaaagttgatacctttgaggaattgagtgatcctgagtgtagccctgatttatcctttttttccagctaaactttctgtttaggtgatctcatcagattcatgactttaatattctccatgctgatgataccaaaatatgtttctcagactctgacttctccaataaactctgcactcatttatccagctgctccctcagtatctccaattatgtgtaatagacaccgtaagctttttatatccagaacagaattttgagtcccttgcctagaaaaatctgatcatcacctggtgttcctcatcttaattaatgacttcatttgtcctgttgcttagatgtggcagattgtatttctccaaatgaccacagcaaagatctcatcccacgtgcttttcttacagtgtaactttggtattcatcctatgagagttggggtctgtaatctttctgcttgaaactttgtggtggcttttgactgtccccaccaatagaatacagtagacgtgatgtttggtgacttccaaagctgggacaaaaggcaaaacaacttccctctggccctcttaggagatgcttgccctggggcaagccattcaccaagctccaaggaacccacactcgccaacatggaggaaccacatggaaaggccaactcagagggacagtgagttccaggctgaagccagcatcacttgccatagatgtgaataaaccagctttaaaatcattcctacctctagcttttgagtcatttggtgatggtccatacactagggcagacatacccttaaactttgagtaatttgttatgcagctttagtgactaaaacattgcaagataatgcattagccatcctgattcctctcattcacacacccatatatcctgtaactgtactttcaaaatatagcctgcatgctgaccacttcttaactgtccaccacagctggtcctgaacaccatcacctcttgccttatttactatagatgactcctaactggtttctctgatttttccctactacagattatattttccaagtagaagccagattgattctttagaaacgttcacaagatcaagtccctattttacttaaaacctccagtaacttcctatcacatttaacatactaccaaactcctcactatcccctattaggccctgtgctacctggtgtctttttctctgaactcctttctaccactctcctccagactcacaatactcaagccacactagactcttactcttccctaaaacattaatctctgagccatagatagctaacagcagaatacatgcctgtcttccatagctgtgggattgctcctgggtctgcaatgtccagctctctttgaacccataagattaattctcaccagtaacatggtgcttcttggatagggttattaggaagcaagtgtgctgccctcactctctggatgccaaggactccatagccctaggtgatggcaaaacttgaaggtggaggcagcctaggtccctgaatcaccacatggaggaaagctgtccatcaaccaggaacgcctgcattggactgtgaatgtgaataaaacttagggtgttgttaggctactgaaattttagagctcattcattatagtacctggtatttctctacctaatagtgttattccctcctcaaagcctttatattggctactgcctgctgctcttctctcccttacatcattctctcccttgcatcatgactctgccccccatttaaaatatttaaaatagtcagtgctcccacccccacacgaatttatactttgtcatactaccctgctttatttccttcatatacttatcactgtctgaaatattcttatgtattttattttacttccgtttctagtagaatgaatactttgtaatagcagggacctggtctgtctttctgttactctattcccagcacctaggtggtgcctggcatgtaccagtgatcagcatttgcttctggataggagcaattacatcaagtagaccgagaacaggaatgaagagttgggaattagggtctttggaaattaagttagcaccacttgataaatgattcaacttctcagtgccttctcacaattgtcaaattgggataatatctattttatggaatagtctgatgattaagtaaaatttgtatgtaaactgctaagacctatagctttttaaattaatatttgttcttatttcatgcaggtttggaggggaggaaataattgccaaccttaacatttattcttctaaaataagtgagggcactgccacatttgatataagtctcatagggtggcctttccagattggagtagtcaactactaggggttgttaacacttttataatatgaaggtctgttagtcagatactttgacacatactacagcagggaattttacagccctggcaattgttttgaccatcacaccatctctaaatgatatgatagaatggccacatcctgttctgactgagccgtgcaagttctgcctttattagtttccatgtggtattgtgaattcacagtttggtggttggaggtatgtagatgacaaatctttgtttattcagatctccaggaagcaaatggtattcttttgcagagtggccaattcaggaaaaacacgtttataagctattgttatgtttttcaaattaaaaacatgaatgaaacataagagagttatattgtaatactgaaaaatattgaggaaaacatgaaattctcctctcccttcacctcttccaagtttcctgtccaagaaaaacttgaaactgtcaaggaatttagtgggtgaattttccacatagatggtattgtgcccaagggagcaaagatttgttttggggaggagtgaaaaaattttactcatatgcgtaaagtacagatatacatataacacataaacagatatacaggctgggcatggtggctcatgcctgtaatcccgccgaggtgggtggatcacctgaggtcaggagtttgagaccagcctggccaatatggtgaaatcctgtctgtactaaaaatacaaaattagctgggcatggcggtggatgcctgtaatcctagctacttgggaggctgaggcaggagaagcacttgaacccaggaggcagaggttgcagtgagccaaaaacaagccccactacactccagctggggcaacagagtgagactctgtctcaaagaaaaaaaaataacaaaaccaaaaccagatatacagtctatgtgggatattaaaatttcatggcgaggggatttcatgggagtgattaggaaataaatgtctacatttctttaggggagtgatgatgaaatgaatatttcagaaacagtggtgtagtgtttatcctcctgttgccttgtttgcacccacacacaatatatatgtataaatatttttgttgttgacttttataatcattggaatatgaataaggaagaatgttgcacagtcactgatagtcatctgatgacaggaaggggacccagcattggcttgaggcctgtgttgtagatgtcagatcagagaactcccttgtgttgtcattgtgctactgcctcaaataactgtgaaacaaatactacccccaagaattcccagtctatgaaataatacatatcctcatggtttgaaccaatttgaatcatgctttctagcacttattcccaaaaatgtcatattagaaagcaccctataccaattaacactctcatatacatttatatgtgtgctcatatatgagattctcttcagaaaaaaaaaatctatactatatttgctggattgcttactgacaatttgtatcttattacagattgtatattaatttatactgctcacttctcctttggatttgttgtggttttcttcatgcttttaggacctttttatttttcctgatgtggtctttattgttaaaatatattgcaaatatgttctccaagtcttccacttttaacttcattttttttttagagatacagaagggcttgtgaaaattatgcattctaggttgtgtcttgcttagggagaccttcccagcccaatactatgaatagtttccactaacatcctttggtaaatgcatagttttactttttatggcttaagatgttacatagaggttacatgcatatatggtggatatatgtagagtgtaatgtattgtgtaagtttatttattttttccctaaatcagtaactcattttctcattaccatttactattttttacttttctcactaatttggaattctaattttcatatactaaattaatatgcatgcctgaatttgtttctagattttctaggtgggttacattcatttctccacattttcttatgcctatattaccctctgttaattactgtaacttctttgtgggttttgtgggatggttgcggcacatgttctattcacaatccttcttcacattgttcacttttaaatttttcttgctgttatgtattttaactcaaatgaatatagttttattgtgtttcagggttaggtgagcagagagagggagagttttcttactaaaatttaatttatttatgtaattgcatagatgactataacttcaaattctcatggctatttctttatccaataaattttttaatgttgtggcctttttaggatgtagtaacttaaaggcaactttcttacctttcaaccttctcatttgtatcccactttataatttaccgagttagtttgcattttctgatttcttcctcaatggaaccttatgaaaggtttgtaattttaatgtccatcttcagaagtgaaaactgaaagtcaaaagaatgaaataattgagtaagtcatatagcagcatagtagcagtaatggaactagaatttgtctgttccacttagtgcagtgtctcggtaattagaacaaactaattctggtatcaagcgttacactttgtttactggttaaagagacatacgagatttcctccatactgtcctgcagcctgggcgttcctttgccatagttgctggatcgcctccctgtttgaacaaaacaggacagaggaaaaggtaacctggaggagaatgccacatccgctgatttcaggctcgatgaagttcaacacttcctatttcaaggtggtgacaccctctacaaatccctggctttaggaagaaacctcttgataaagacccctcatccacagagttgcctccaagcctatccttgttctaatccttcttctctgcatgaccaaaacttggtattcaaaattcaatcttagtgttttctggctgtgctaaaggggatgtggggacctcatgtttggcttacctgcaccttctaagctagcaccactgtcttacttaatggactataatttcatctccttaagctctcttcagaatgctataatgaaggaggtgtgacttgggtttggaaatgtggtggcaaattatctatatatgaattaacatgtataatttaatacacatcatgaataatgatgaattgcaagtttaacttgatcatttaagtagagggtaaaatttctctttgtccctggtatattttatagagtaaatattaaaatttgatactctggctttgtggatatggtttcatgatgtacaaccactgtttctaggcagcccactccccagtatcacattgtagacaccttgaggacagggagatcttctaaatctgcttcatctctttacttcccaagacaccgtgaccaggctctagcatagaatatttgtttgctgaataaaggaattaatgaactaatgaactaatgaactaatactactttgcacttcacacatctctcaatttcctttatttttgtattcatttctagaatcatacagtgtaaactttaggtaacaatatagagataacacttttcccatcctgtgcaatggcattttgccactagcaggatgcaggagacaattggaaaggaaacagctttaactgtgtccattttggccagctgttctttgtaaaaggtctgtgataaaatttgatataattcagcacattttgcattagttagatattaatgttaactgataacttttgctcctgttagtatagaaggagtttattctctatgaacttgtcccacaagaagcactgtcaactcagaaggcagtagccgacgtttttggtatttgctccaggttccttttcagaaaaggtcattgttggatagaaaggcagcatgctttggtggctctaccaagtggagtctatgaatcatcacctggaactatgttaggaatacaaattcagtgatgcccttcagccctattaagccaaaaactctgtgtaggaccaaatagtcagttttaacagcctgatcatgtgattctgatgagcactaaaggttgagaaccttgactctgtggaaaaaaagccaggatctgaattgggcagaactgaatcagaattttagctcagccatgtattgtatggcttcagccatgttaaagaaatctcagccttggtttctttatctataaattgtggagcttaatacccacttcattggttattaaatgaactataaaatatcacactgggcctgccagtagaagccagtcaacacatttagggttgtaatttcctttcctcttgctaccaccattgcatgaaatctaaagtagaaatagtagtttttaatcctttagatatgttattatgtatgatagtaatgtatagggtttctataccctgagctttggagttgacacttttctgacaaaagaatgtgatttacttatgtattttagctgataaatcctagatagaaatgtatgttcccgtctccctaaacatagtagctgtctgtaatcccatgtgagtcagagatgttccagttattgactgctgcataacattctaccccaaaacttactaaacaactatttagctttgctcatgagtttgcaggtaagaaatgcagggaaagcttggctagcggagtagtctctgatcagtgtgttcttggctagggtggcaggggctagaggttcccctccaagatggctcctccagtcacatgtccaacctccttggagctggtcttgctctcacatggcatcccatcctccagggtctgtcctcttgttttaggatttccacagtatggtggtcagggaaaatgcacttcctgcatagtgattggctttcacgaggtaggtagtggaagctgccaggccagttaagacctctgcttataaccgacacaactcgccctgttgctcagagcagtcacacagcctgctcagagtcaagggagagaagaaatagattctgtctctcgttgggtgagtgacaagtcacaatgcaaacaaatgtgtgggatgggagatgttctgctcatctttggaaaatatgatctgccacgagggctcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccacgagggctctttagtagggaatagtatgttgttctttgtatgcagctgttaccaaaaatgcttaaaatagattgaatttaacgattacacctaaacatacatacatgtattttaattacgtttgttgtctaagttttgccttttaatccttagcaatgtaatttgagtcaagtcaggtgagttgttagtgtgagagtgagctgtcatgtcatccatccacgtccccgcttggactgttttacacgacgggacacacgtccactttcatgatgcagtgctaagggttgctctgtcaatgtaaaagctgtgtccgagcctcagggcatgtaaccttacagctccgtggtggagttacatgctttgttgctgaaggaaggaatgttttcattagttttctttatttttgttccctcagtgggatgttattagtcatgtagaggcagaatttctgtcctcctccacctccaaccaggaagtattaatcactgtttcatctgtgttttcgtagcatttgggttattatattattgttttttgctgattattttaatcgtacaaaaaatacatgagtacattctgtttataaaatttcaagcaataaaaataaaataagtgttcacattaatctgcatccattttcccatgctaatcccttcccagagataagcaatgttatcaattttgtgtacgaccctccagacatattctctgcatcaagatatacacagatatgtgaacatgtataatttactccaatggaatcatattctatatattgtggtttcctttattcatttaaccgtattgagttggagaaatttatatgtagaataactttattctttttttaaaaaacagctgcatagaaggagaatcacttgaacccgggaggcggagaatgcagtgagccaagattgcatcgctgcactccagcttgggcaacagagtgagactctgtctcaaaaaaaaaaaaaaaaaaaaaaagaagaatattagaaaattacaaaaaaattcaataaaaacatctgcaacaaattccatctcatgaccgtacagtagtgaatttaactcttcccctacagatgaacgttgagattgtttccagattttcactgaatacaataccctagtaaaaatttctgacattgttctttgtgcacctgggtgagtatgtgaccctgtgtctagaatggaatactggatcagacagtgtgcatgcccttatcaaagatactactgccagactgtcttccaggaaggccattccacagagagtcaaccccctaccacacggcctcatcaatgatggctttttttaatcttttctgagttttgcatatttgataggagaaacagatatatccagttgttgtctttccatttccatgttcattaattaggtgtcccatatttttccgtgcttattgagcatttgtatttcatcttctgtgactatgttttgttcattttattatggataccatagaagtgtatatgttttcttgaaacttcattttgttccattgataattattttattcttgggcccaaacatattaaaatgtaacatttacccatttaatattaatttaatacaaaatatataccaagcatcattgggcattagaacattacaaatacaagggtaaagaaaacagacaaccagctgtgttcctgacgaatttccggaaagtgctgaagtattaaaggtccatcctaggccatacctacatgggtgaccctggcacaggcctgagtttttgctggtggctctggttatagtatattttgatatctggtaagatatctgagaaaaatttctgtctctctctgtcatctatcaatgaattcttccatctttctatctactacttattagatgtggggacttagacaaattcttatcagatgtgtaatatagatccaggccatctggcttcagagtttatattctttcttttgtagatttaatagagtttatattttttcttttgtagatttaatataaaattgtaaattttagaacttgtcaaatttcatagaaaagtcatttgggactttgataggcacagtggggtgtgtaataatgtattaaatatttttatgatactgagttatcccacttagtaccattgtagaccttcattaaatcatctatgattttatgtcatttccataattttgtccttgctcattattagatttatcctcagatattttacaattttgtgctgatacaaatgggatcttaatagcattatctaactcctttatagtgtaatggaaagtgtgaattttttgtatgttgaccttgaatctgtatattttgatgatttgttggtgtgtgtcctaagagttgtgagttgatagtctttgatattctaagacaaaaataaagacagttttgtttctttcttctaatcttcctaactcttatttcttatttctaaattattattattatttggtgtatgtattcaggacagtattgaataagataagatgatggggaaatccttgtattgttttgaacattaatggaaatgctgacttttttctgaacatttagtataatgtatactttaccttggtgatggataacttttatcaatttaagtagttttttcatgctttttcttgtactaagagcttttaataaggaattgagtttgaattttataaatgtttttcaacacattcaaaggtaatttactttttatatcaattaatgaattgatttacattaatatacagctaaatgttgaactctttatccctgaatttctgataaaagctctaccttgtcataatatgttcttttaatatgctactaaatttttaataaatttatttttatataaatgtaatatgtgtatatatataaaatatgatattatgtatatataatataacctttttctaatgagtaaaaatggcccacctttcactgccttatcctcttgtttctggttttagtatcagggttaactggctctgtcagatgagttgatttttcttatattttctgttcttctatttatttatttatattttttgtagaaatgggagtcttgctttgttgcccaggctggtcttgaactcttgggctcaagcagtcctaccaccttggactccaaaagtgctgggattacaggtgtgagtcattactcctttctattttctacctttggaaacagatttcctaatataagaatgatcaagacatgaagtctgatagggtctacctgtacatcagtgcaggcttgatttcttcaagtcatcttactagtataccaactttctcagtggttattttactgtttagataattctctttgacccagttttggccatgtagcttttcctaggaaattagtcctatcttttagatcattagttgtatgaaattttttatactgcaagtaatagtttaataaaatcatatatgtgacatcattaataaatacaaattttatctatagctttgtcctttttcatgctatttgttttatatttgttctctctctttattgcttttaataggagataggttatgaaattaattgagcatgtttgtcttttcaagaacattattttaaaaaattttctattttatacacttaaggttttattttttactaattatttataactttatgttttgatatatttatattttaataggtccctaatattcattatgtatcatatatttgtagctataaattttcctttgaatacaatatcatctataattcataggtgttaagttttattgctgattgttgtttttgtataagtagtttgtgatttccctgataatatttatttaatccaagtttttaacagaagatttatcttaacatttttcccttgtgttttttattttattattgtataggttttttttctttcattgtttatgaatgttgaattttatttcataattgtgaatgggactttttgttaactttagaaatattctgagatttcctttgtattctgctacactgttattttaggtaatgttctatatgtgtttgaaaaaagtatgtattttcattgtggtgggtgaaaagtcgtatgcatattagatcaaattattaattgcattaaatatattctctatatttttatttatgcgtgcttatatagtctgttgatttcttagaaagttagattatccaactgtaagagtgagtgtgccaatttcctttcatattcttgatttttttcccatttatgtgtttggaagctaaatttttagttccataaaagttaatgtctttcatagtgtttgggtagaagaattttccatgttgtttaaatggaatagctttctttgtcttcatttcctattctttctacaatttctgagccattttatatgtctcttttgactgcatatggctgtatgcttaaatttccaatcagaaagacttgttaggggaattgagaccatccacaatattgtgtttactagtgtatttggacttgctcttggcagcactccttctttattatagtatgtttatggatatgcatataaatatattatgcctgcaatgaactatgaagcattattgcctggcaacatcaaccttagttttagttttattttcctagtagttttctcattttgattaaaaaccacagaatgtcagtggaaagaggggcccctgctctgtgccctgcatttgggcaggctctgcttttgttttgggcaaggagaataacaaatgcttggagcctgagccactgcctcaagcctcctagggcctggtaggcctcttacaggattctcattggccaaatgccaatcagtgagtggatgaccatcctctttagactctattctccccaataattaaactctgtcctaatcaatcactctaaggcatgactgtgggcaggggagagtgaaagtgatgggcagaatttggacttgggactgggtggtccacttaggggtgtattacactacttgccacgcaagttgaagctgagggatgagagtgagaaagtgagatgtcacctccctttttgttcctcttgcacagctctgacgttgggggactgggcacccctcttccagctgccgtgttttggcaggaactctgagaatgcttgaacttaaaactggcattttggatctttacgtagtggtatttccaagtaagaggaatagagcatactttatttaacaactttgatgtcctgacttactacttttaaacactaagatttatgtgggcttccattgttactcttacctcaggccacagacgtcatagaagagcttggaaaaagttaaattcttggggagaatagaatagaatctaaagagggtgatttttgactccagcatctctcaggtttctgtttacccacctgcaccttctcttctggttctgaggcaggtgcttatctctttggagatgtgctgaggcagaatcagatcaacagctcttgcagagaagacgaagtgaggcgaggttgttaggtctagagtgcagaggggccagattagagtagccctggttggtggaagtatcacagctgcaaggataacctgagtttcctgtgggttaagaataggtcatgtaaggtatctgactgaagccatcttgccaggtctcctgtcaacagtggagcattgttgaacagattatgaggggtaagagaaggacatgaccgtgcttttgctggatcttctgtgtcagggacctgaacaaagttttcctgtctcccctgccaccaccagcagagcagtgaagagcaaccaatatgtcctgagggagctgcttttggaggcctgaaacatagaaggaaccaataaccagcatgtgttagaggaacaaaaacaaaaaaacaaaaaacaaaataacagctgtaagtaataagacctgcaaatgcaaatcaatgtcttgttccccctaaaatcaataggtcccctgtgccttccggcacactcacacactgacacaaccacatctggctttcttactggtgtagacaggagggacgagcagggggagcagagagagagagaggaaacaggcttcttgaggcatttctagtctgagctgacatttcattttaaaatggaaaatgatacacaaaaaaatccagcgtgaccagaaaaaattataagcctgatacttgtagttgacaagagtaagttacctttcccgtcaccagttcacctggtgctgataattcagaaagcacatatagtatcaggtactagaaaaagtaaatcattccacatttgcctgttgctaggttgaggcaacttaataatacctgctgatttctctcatgtctggacattttgagtgtgtgtgtgtgtgtgtgtgtgtgtgtgcacatgcacttctgtgtatatctgtgcatgtatttacaaaagtagagtcttgtattccaatgcccgttttaactcaatctcttcatacagatttcattccaacatttgtcacaagatattgcactatttttttttagctgtctatctttactgctagaaggagattttttagaggagactccgatttaaatattgcttctatcatagtgtaagacatatagtagattctcaataaaaacctgtttcttacatttaagctagtgataatgtttgtacctattaagggtgctgaggctattttccaagacccagttggaagatactttaaaagtaacttttctagatcatctgttaatacttctgtagccttttacaggaacagaggaaaagtaaaataggcagtgaggaaggaagtgctgttatttttgtgcatatagcatagtaaatgtgtatgtacctggcatttactggtaaatcaacatgtcagagagatgttatttgttactggctctgtgactaattatccctctagatataatcagtgttaaaggtagtgaagtgcaaaataattgcaacaacaagacctatgattcatttcaaccaggtttatagagtaaaagattctttttcttaactttagcagttttttaattgattctgtaattttacaatggcaaaaaggtagtttgcagtgtaattctctattatttccgtattgcaaattcaatctatgttagatatttgatgccatgggttagcattttttatttgcaaattaagtattttgtgaacccaccatatgttgaatgatatgtagaacagaggcatggagaagccagaaatatttgtgtgtgtgtgtgtgggtgtgtggtgtgtggtgtgtgtgaaaaaaatatgctagaccaaggtatggagagtcagacttccaaaactgcatatctcatctgagtacaatccttctatccaggggagatttaggtttggtggggctcaaacctcatacaatttaggaagcacattttaagaataacaatacaaaattaagaacacaacagtggctgggcgtggtgactcatgcctgtaatcccagcactttgggaggtcaaggcggctggattgcctgatatcaggagttcgagtccagcctggccaacatggtgaaaccctgtctctactaaagatacaaaaattagttgggcatggtggtgggcccctgtaattccagccacttggtaggctgagataggagaatcgcttgaacctgggaggcagaggttgcagtgagctgagattgtgccattgcactccagcctaggcaacaagagcaaacactccgtctaaaaagaaaaaaagaacacaacattaagtattgtgcctatgcaagtgaagagccccgaggcttaagcttcatgcgcttctttgtaaatatttctctttttatatcaagtcagatttgatacttctctctgttggacatgtgggtatgtaatagcttattaaggtgaacagaggtcttggcatatgggtggtatagaagatgttgtaaaggtgaggacgaatttctaagagttgagatgtaaagtattgtttaccactgataaagacttgtatttataatatggaaatttagaaaacagagtgaaaatatctattatttaataagtaatggaaaagatcaactatgatgacagggacttacacttctggcccagttggagtaaaagagaccttctgaatgagacagcaaaaaagtaataaatggacagaatatatgaagcaaaggttttcaagatactgaacatcagacagtgaagtacagtgatcttgaggtaggaaacaaatgaggaaagtcatatgattgtgccagcctactgctttaagacagtttccaacgtgtagcacagggaggagaacccaggtggagcctggtgatcttgaaaaggagataaagctgaaaactgcagggagaccatggtggctagaatgcacaggacaaagtactggagagaagagatttgtctagagaaaagtctcaaaagatctgtaggtagatacattatgacagaagcatagacatgtgatagaagcaatatgtaaagggatgctttgggtatttagtagaggactgcacagcacatgcaggtgaggaaattactaggttttggaaataactacccaaaatggttagtgggaacaatacctgacactcacactgggccagggatagtgcctgttcctacctgtcgactggaaatttcataaccatcaggacattggatagtactcagagtgtcatgccttagttgtggagactaattaggcatagactaacactgtttgaataccacctccaaagttgtaaagcaaaaaataaaggatatagattattttcaagtaatgtaagtacattctatgaaggaaattaaagaatatctataggaatacaaaagtaaatatcaagcatcctacatggtaaaattcacaatgcctagcacccaatcaaaactaaccaagtatgcaaaaaagtggggaaatatgatccatattgagacaaaacatgcatcaagaaaaatccagaacagcgatagcagacaagaacggtaaaatagttattaagactacatatcctatgttcaaaaattaagtacaaagaagacataaaaatataaccaagtcaaatgcctagaaatgaaaaaatactgtttgaaataaaaaatacactagatgagattaatgtcagattagagactacaaaaaagtaagtgaattggaaaataattatttaaaataaagtaatagaaactatcatgaaataaaactaatagaaactatcatgatgaaacacagagaaaaaacaatgaatgggacattagtgatctgtggggcaacttcaaacatcctattataagtgtaattgtaactcttaatgaagagagggaggacagaaaaaaatgaatcaataacggttgatttttttcaaggagctcaatgaaccataagcacaagaaattggaaggaaaccacacaaaggaacatcataatcaaattgtttcaaaccaatgattttaatttaattgcatcattaatacaatgtaatttaatttaattttaaaaaacaatcttttttaacttttaagttcagaggtacaattgcaggtttgttacataggtaaacttgtgtcatggggcttcgttttacagattatttcatacccccaggtattaagcgtagtacccattagttgtttttcctgatcctctccctcctcccacccttcacccctgaaaggccccagtgtgtgttgttcccctctatgtgtctatcatttagcttccacatataggtgagaacatgcagcattttgttttctgttcctgtgctaattgctaaagatagtggcctccagcttcatccatgtccctgcaaaggacatgatctcagttttctaatagttgtataacattccatggtgtatgtgtaccacattttctttatccagtctatcactgatggacatttagacagattccatgttttgctattgtgaatagtgctgaaatgaacatatgcatacatatggctttataatagaatgatttatattcctttgggtatatacccagtaatgggattgttgggtcaaataatatttctggttctaaatcttcgaggagtcgccacagtgtcttccacaatggctgaactaatttacactcctaccaacagtgtaaaagtgttccttttactctgcaaccttgacagcatctgttatttttttgactttttagtaataaccattctgactggtattagatggtatctcattgcagttttgatttgcatttctctcataattagtgatgttgagcttttttgtatatgattgttactgcatatatgtcttcttttgaaaaatgtctgttatgtcctttgcccactttttttatggggttgttttttcttcttttaaatatgtttaagttccttacagatgctagatattagacctttgtcagatgcatagtttgcaaaaattttctcccattctgtaggttgtctgtttattctgttgatagtttcttttgctgtgcagaagctctttagtttaattagatcccatttgtcaatttttgcttgtgttgcaattgcttttggcatcttcctcattaaatttttgtccatgcctgtgtcttgaatgacattgcctaggttgtcttccagagtttgtatagttttgggttttacatttaagtctttaacccgtcttgagttaatttttgtatatggtatatggaaggggtccagttttaatcttgtgcatatggctagccagttatcccagcaccatttattgaataaggtgtcctttccccattgcttgtttttgtcaggtttattgaagatcagatagttgtaggtatgcagtcttatttctggcttctctattctgctccattgatctatgtgtctctttttttaccagtaccatgctgaagaaacaaccttaaaaacaaccagagaaaaaaaagacatattacatacagaggaaaaatacaaggatgacacaagatttttataccgagccaagcttgttatgactgtggcatagtaagccaatcactgagacaacagttttgtcatggagaataagttttagacaaaaagcagagcaacaaagagatgggaaagcagctctaaaatccccctccccgataatggagttatagggctctttatgggataaaggagcaaggtggtccaagacatggggaaaggtgattgagagtaagaaaatatgaagcaattgatgatctgcacaagcatagtcaagcttcatggttcttcataggatgcatattcacaaattatgtcattagcataatctgagagtggagtttttggccctctgacatcaaaaagtcacgcatctatactcacacaggcccatttggagggtcagtggtctcagtggcttgaactggatgagaactaactctaagttcctgaaaaacaacttaagtaattgttaccatggtgacatatatattagagacattatgtataaggaagctagtgggagtttagttaaacttgtttagccacctgacttttagctacataacgtcttaaaatcaactgaaagcaagtgactaaaacaaggcagagtaagttaagttgggcaggcctaatctggtaagccttcagttttagtatcttattggaaacaatgagaaatcattggagcacggtcttgtggacatatagctctacacacagcaatgaagaacactggaaaggctttgaaaaaaaaaagaaaaacataaaatacaatgaaaatataaaacttgttttatccaaggtgccagtatctctactgtttgcctactgcaatgccaggatctcagagacaaataaaaaatgtgatagaaacaatcccctatatcagtagttgagaggacaatgcaaacaaatacatcagagaatattatatgagctcatacaattgtgtaacatctatctatctatctatctatctatctatctatctatctatctatctatctatctatctattcatccatccatccatcccatggtaatgcatgacatttatcatggcaggtgtctcagtctgggttttcccagaattatatcctaagatgagggttagagtgcaagtaaatcacttgggaagtgattcctggaagcaccagcaacgagtgggaaagtgagatggggaaaagggaaaggcaggccacaaattaaagtatcattatcaagaagataaacactgtgtgcaactagagtctaatcacaccaggaaattgtggatcagtgtacagcagtggcctcaggtggaacttactcttgcagagagaatcatggccttccaaagacaaccatgccctaatctccagagcctaagactatgttatgttacatgtcaagggaaaattaagatttcacatgtatttaaggtcactaatcagctggccttaagataaagagaatatcttgcattatccaagtgctcccaatataatcacaagggtcttttaaatgaggaagaagaaaacagatggtgaaattcagagatagatttgaagctgtggctggcttggaaggaagggggctataagctgagaaacagaggaggcctctagagctggaaaggacaaggaaacagaatcttttcttgagatttcagaaggaatttaactctgttacaacctgattttagcccaattagacacattttagatttaataccttcagaaatataagatatttgtattgttttaatttaccactaagtttatgttaatcccttacattagtaatagtaaactaatatacccacttgaggggtgaggtagttgggtatttataacacataccattggttggtaattgcttctgtatgtggaaagaaagtggcccccaaaagagagagaaagccctttggttgctggaggttagctaataggcactataaaggtaaggcctgctggaatgtgggcactgcacttactagtaaaataggctggcctccctcttcctgtcctttccaccccttcttcattcatctaacatttctcgagcttttattatgtaacagactttatgctagatgctggaaatagaaagacactgtatacatttctagcctagaaggttcaacaaagaggaaaatgtttacatttcctagattctcagttctagactctaggatagattgctgagatatttttcatcaatggaaagaaacacatttttgttgggtttttcaaagaacgtgacatgacacaccatttttacaagggataattttagtgcagaataaaatagagcagataaactgtcacccaaatgaagaaatgccacatttattgttctaaggcgtccagagcaagatatctttttggtatgaatgtgcaattctacacacaattatttctttcttggatgtgagctaatttctattggacattaaattctataggaaggtgaagattagtctatctggatgcctgtttgtttttaatgaagatgttacacaaaataaaaatgaagagcatctgataaacttgtatacaaacactcacacacaaatcttctttaggcatatctcaaggtatttttccttcctcataatgtgctatttacacttgactcataataccagtttctaggtatttcagaatacccagaagtttagcacaaatacaacaatggttatgctacagtggaaatgaagtaagcaatagatgctactgcagtaatttttgaaatttctttgttcttataaatggtcaggcactgcattaaaatttggaagattgcacacttgcagcctctggtgacttcccagattgaatgaggtattgcctccctcatactcttgtaacaatctttagacctgtatttctcccttccatgttgtagggtagctatttatttaatgtctgtctactgcagtaagccgtgtgtgctcctgaaagctgggttttgataatcttattgttctttctctggcatctagatcatgcttgacatatgttaaattctttaaaaatattcaccaaatcagtgggcaaaagaagttgacaaactcaagcaatgtatttcgtatttattattttataggcttaaagtagacaattttgttctgtgttggctgagttaatcacttgtgaaaaacagcaaaattatattgaatttcaaacacatgataaccttctgttgtattgagctaatcaatgggtgtgtttatcttctttttactagtaccatggtttactgtgttttccaaaatactctttgtcattaattaaaacaaaccacattatggtaccatataatctattttctaaatgaaaacactctgtggttttgaaagttcgtttctggtccacaaacaaataatttcatgctcttatcctcatactatttgagtcttagtttttccatttatacaatggagaaagtaaaaatagaaatgcagttttttatttcagagagttattatgaggatcaaataagctggaggacatcaaagcaaatagtatatcatcttttcttttactttttattttttatttatacctaataattgtacattttgtggggcacatagtgatgttttgatgttttgatacatgtattgtatcagatcagggcaattagtattttcgtcatctcaaacatttgttatttctttctgttggaaactttaaatatcctccttctagctatttgaagctatatattatcattaagtacagtcatcctatagtgctatagaatgctagaactttttcctcttatgtagctgtaattgtgtattatttaacaaatctctccctatccctctgttccccttacccctcccagcctctagtatcatctgtattaagaaaatacggatatatggatgagaggacaacaggttatagattttgatagtgggatatcttaaagggaaggaactagttaattatccataaattccttcaatggtgtgaatattgccctttattatggcataattcttaaaatttatgctattgctttgagaagcacatcgaagagccatgccaaaccattctataactttcaggaccttggacagcttctttgcttcaagatagccaagaggttaaggcaaagacaacccaacagggcaaatttttttttctgaaaaagaaagtttgtttttaacccacactgtagcgttgtttatagcctcctcccagttcatccttgaatccatagtatatttctctatacatactcctggataagaagaaacaaataataggaagataaagttaggtattgtcatcagagcattaacacagtgatcttattttcgtaaactcttaatatcatatatatatatatttgcatctttcttttttctttcttttgtttttagagatagggtcttgctgtgttgcctaggtttgtctcaaactgctggcctcaagtgatcctcttgcctcagtctccaaaaacattgggattataggtatgagccaccatgcctggcccagcatcttatgttttgtagcatctagccataatgtatttttaaaaatttcctggccgggcgtggtggctcatgcctgtaatcccagcactttgggaggccgaggtgggcggatcacaaggtcaagagatcaagaccatcctggccaacatgatgaaaccccgtctctattaaaagtacaaaaattagctgggcgtagtggcgcacgcctgtagtcccagctacttgggaggctgaggcaggagaatcgcttgaacctgggaggcagaggttgcagtgagccgggattgtgccactgcactccagcctggcgacagggcgggactccgtctcaaaaaaaaaaaaaaaaaaaaaaaaatttcctgtctgtctgaattcaggaaccccaggtaactttgtgtcaatgttatctctgatttcctccacagagtctctatgggaaatattgtagaggttatggcttccaccctaacaataatataacataaaaggaaattctaaaatcttgctcatatctaatgggagcatttttgggaggcattgtgcacacattgctagagagctatgaaggaactgtttcaaatgaagagaaatgcaagcctaggcagtatgaaatgtatcttggtaacagccctctgtcctgtaatttatcccacctagttttctttttgtttagattgtcccacttaatttccttttgtttagattgttggtttttattttcagcaatgtcaaatgtaggtagtaatttgatttataataagagcttacatccaaatgttttgatagcagagtcaaaagaaatacaacctgagccatccccagggagtcatatacatacggactcacatgcatgcacaaacacacacaggagccacatttgcaactgcattacggatttacaaaattacttgtatttcattcaagaccgctctaatgggttttaccagatcagaagtgaaaattttaaataaattaatagacagtttaacccaggttatagtcagtcactcaggcaatcagtctagctttgtctgtgtattttacaaactggccacccaagttcagagtgaatataggaacaaaaaatcaagaagaccacaggtaaacataggccaaagggttaaccaaccagcccttactaaaaaagttagtcgtcatcattttgccccacttcctcatcgcctttcatggtgtttcacaaattttataggtaaatgagtaaggatgtgatctcattcacttatctattccgtttgaatataaaacattttgtttccttcccaaatctttaattgtatcttgataaagaattcaagcttctttgtactttgtaggagttggagatttttttttttttggttgatcatgaattattgaagttcagtggactggaattggaacacttggatcggagattttattctgccaattattacatgtgtaaatttgggcaagttagctaactttagaaacagtcgtcttgtcagttaatgagggtattattatatctgtaatgcctttcatcacacatggcttttgggggagtcagataataagagtaaaagtaacttataaactgaacaaataaaaaagacaatgatttaccaactacttccaacattactatttaaaccatgactttgagatgctatattttaagaatgaaaaagaaagtaatctttattttaaggagaggggcaaggcaataattttccataagagggcacagacactatatacaaaatggaatctgtctcagttttcagaattttcatttgctagctcgagtgcaagctgcttgtgttagtttgcgaggacttccatacaaaatatcatataataggtgctttaaataacggaaatttcttttctcacaattctggaggctagaagttcaagagcaagttgttggaagatgtagtttcttctgaggacctctggcttggcctgcagatggccaccttcttgctgtgtcctcacatgatcttttcttttgtgcacacacatctctggcatgtttttgtgtgtccatatttcttataaagacattagtctcattggattaggacccactctaaggacttcattttaagttaatcacctcttgctcttgctctaaatacagtcacattctgagttatggatggttggggcttcaatgtatgcatgaagggagcataaatccgtaacgtttgacttttggatctccaaaatccctgtccttctcatatgcaaaatacattcaccctaatcccaacagtccaaaatctttaccgatttcagcatcaattctaacttccaaaactcatgtaaatattatctaaatcaagtatgatgagagacttgaggtatgattcatcctgaagcagaatttcactccagctgtgaacttgtaaaattgtacaagttccgtatattgaaaatccattgctaagacaggaatgggatgaaaattctcattccaaaaggaataaatatgaaagaagaaaggaatcatagatccctagcaagtttcaaatgtaacagactaaattctattagatattaaggctcagtagtaatcctgtttggcttaatgccctgcgctccaggcccactggggtggtggctctgctttgtgggtccaccgggacagcaatgttgccttagccctgggaaatagcgtcgtcttctgatgccttgagtgacagtcctgtctctatcatcctgggaagtggcagcctggtccactgaagctaaggaggtgcccctcattctgaaatcaagaaagagacagccttggctttccatcctcccaccagacctgggcccatggtgagagtggcagtcccgccaatctctgaatagcttctggggtcattctttcatttccttgatgatggataacatatgtttacagccatttaacttgattaaatggatattgaattctcccatcctgtagaattctggtattccaatagcctttctttatttggggctatgtctgtcccctttagtccaagccgacagtgttttctgctgatataagcccatatttattcctggcttctgctgagataagtgattagatctatgagtcacatccataatttctttatggagtaattgtccagctacattcttggttttctttccaaaacataccttttattttttttcaataggaataagctgataattattcaaatattcaagttctggttgctttttgcttaacaatttcttcttcaataatctctttcctcttgcagtttactataagcagtaaggagaaactagactgtaccttcaacactttgctcagaaattatttcagctgaatacccaggtttgtcacctacaatttctactttccacaaaacactgggacacagttcagctaatctctctgccattttatggtaagtgttgtctttcctctagtgtcaaaaaatatatttctaattttcacctgaggccacaacagaagcaagcacatttaatgtccatgattttacagaaagtttgttcaaggcaatctaagcttcctctaatctgtgcctcaaacctctcacagcctctactcattacttctaaagctgcttccacatttttaggtgttcagttctttagcatcccacatcgtggtaccaaaatctgtattagttttctggggctgccataacaaaataccacagacaacaaaaatgtattttctcatggttaggagactagaaattcagtatcaagtttcagcaagcctgagcctctcttcttggcttgcagatggccatcttctgtctctgttcccacgtgatctttcctttgcacctgagcatccatggcagttcttttttgtctacaaaatttcttcttcttacaagaacaccggtaagtttggattagggcccaccctaagagcctcatttttacttaatcacctctttagaggacctgtctccaaatacagtcacattctgagattctgggagttagcgtttcaacatatgattttggaaagacagtttcgtaacttaacaataaatgaacaatttgagcttaacataatgatgaattttgacttaggaagaagcatagctttagcccatgtaacactgttgtatatcatcactgtgaaaggactggcatcttagtgattttaaaaccatgtttccctgagtctcgggcagtgagtcaggagggctatgtagactgtgtccatggttaggtggagatgctgatgggtttcggctctcagacctgttggacacagatgtaccataccaggggaaagtgctaaattgcttgtaaattcactggcactccaatactctatccatgtctggaaataaatgaacatagagtctgtgatcatattaactgaaccacacatttggctaggaatatcagatgataaaactgagtaattaaaataaaaattgttctaggatacctggaatgcacagcaattgctccttttcttaaatgttgatggccttacgcaatggtgttcacagcacacccctctttatcttggggatgctttctctgatggatgggcttcaaaattgctaatacacgaattactcatatttagacatttgttcttttaggtgccagactgttttcttttggaatgtatttttgtgtgatgcaatttgtcacctagatcttagcattaacttttaaaggatgaatgttgatatattggttctctttttttataatttcttgtatgacaaagtaattactacctactgtgttctaggcaccacactaagtgctattaatgtagccgtgaatttacgttgtcttcaccaagggtatcataatctaatttaaagtattttttcctcttgtagaaataccttcttccatgtataaaggcacctaaaatgttgtacagctcaattaagcttagtatctttcttgttttactcaatctcagtttataactgttgtagattaaataatggcccttcaaatatgtccacatcctgatccccaaaacttgtgaatgtttccttttaatgctaaaacaatttaaatatgtgattaaggatcttgatatcgggagattatcctggatcatcctggtgaactgctataatcacagttgtttttatgaaaataaataaagaaggttcaaagaagaagagaaggtggcaaggtgataatggaagcagagataggaatgagtcactttgaaaaaggtggaggaccccaagctaaggaatataggcagccactaaaaagcagggaaagagtctcccttcaaagtccccagaaagaatcaaccttgctggtaccatgacattaactcagagagaccatttttgaacttctgacctccagaattgcaagataataaaattttgttattttaagccactgaaggttgtggtactttgtcatagcagcaacaggaaactaatagaatcacattaataatcaccagtacactcaaaatcatttatctacattcttctttacaatctgctcccacatactattaccactgttattaatttatccatcttaattgtaatccttccttccgtatttgcatcatgctcttaatttagaaacttgacattccacttgaaatcttatggtcagtttccaaatggtatctctgttttcagcctcactccttccaaacttttctccagattgtttccaaaattttctcataaaagccaaatacgaacttttttcttcttaaaatcctgtgatacctcatgagcttctgtcctgtttgccaaactcctattcactcgtcaagaggcagtttaaatatcttcttttctgtgactctttccacagacataaatgtttgcattatcttctatgtttcaaaggcatcttgaatatattttcttgaaaaatccttttatatctatcgagacagatagatatagagatagatgcattccagggcagcctgttttattactatacatatacaaaaagactcaaaaggataagtaataaaatgtattaactgcaaattccttctggaggtaacattataaaatatgtgctaataacaggagaaaagaaacagtgaaaaaatacaaaacggtgttttcaaaatatgtttttcataaatagcaaaggctttagaggagatatgttacaatgcccagaaaacacaaaggaaacacagtatgcaaagatttacacatgtatgtagacatatcagggaagggaccagagaacaggaagataaatacaataatagttaacatccattgtgtgctttccatgagccaatactgttctaagggttttcatgttaattcactaaacaatccttcgagacaagtgttgttaataaccacttttaaagttgttatggagactgagcacaacattaatacaactaggaagggatttgaactcagaaagtctgtttccagagcttgttttcatatccaatatgctttaccatctcagctggaaggttttccactgctgctggatgggcttttctgaaagtgacctaggccaagccatgacggccaaagtggcccaagctcatcttcagagatgttcactggatggtggtgttcttatttttcaactccaaactcagcctgtaattctcaccaatttcaaatctgcaatcacttaagtctataatcgctatcaatgatatttctaacacatcccagcaattcttaaaaatgtctctccttattgtaagaactcctaattccacgagtgattattaatgcagggagagagatgagaagttacctttggggatataattgaaaagtgagtaggaagcaggcagaggaagatgaagtaatgacagagattgtgttgtgagtaacgcagatactttcaataggatatgcccaagttttaagtgtgtgaattttcaatgcttctctttatcctccattgtgtcatatagcatgaatcacccacatgagtgggtcatcaaatcaattttgtgggtcacaattagcctttgataaaggaaaataacatagaatggaacagaagagcataatatataccataacatagcgtaggtatatttgcataaatctgtatcagtcatttcacactttgcaaaaattactgcaacaagtggtaagtcacagtgccagagagccaattagtagagggagtacactgaagatgcccactgggtagaatggcttgttttgtctttttaaaattaacttcttatttgattttttggcctgggagaatcactttgatcatcactgtaaagaaagggcacagtttattttatattaacataattattagttaattgtgagatgaagccaggaattatttttctatcatgaataaaagtattgagattttcagtcaagtttcaggctgcaaaattaggctgtttttcagaaagaacattaccaaatttgtaactgtaacattctagtaaatttaatactagtacccttaaaattaactgatatattattaaaaagaaaaaattatgaatttaaaaatgtaaaggtatgttttagttcaactgaaggatttcaaaatgtaaatagtgaaaacattgagaaaaatattgacaaaggagcaacactgtcaatttcaggcaaaagtttaaaatgaaaaatttagtacaaatcatgaaacctaagacactcaaaatcattttaatcaaatatgaaaaatccagtgaaaatgacgcctgtgtttatgtaatgatattttgcaaataaaaccttaaaactttcaaaattaaaatgatacttggaaataaaggttattgtacttaccatgtcttttaattatttgtaaggaagggaaaatataaattcattggcacaatgtcttattcatttgaattttttattttattttaatttttttgaggcagtcttgctctgtcacccagacgagagcacagtggcatgatcattgccatcttgatctactgggctaaagtgatcctcctgcctcagccttctgactacaggtgcatgccaccattcccagctaattttattttattttataatttgtagagacaagtactcattacatttcccaggctgaacttgaactcctgaacttaagtaatcctcccaccttggcctcccaaagtgctgggattccacaacctttaatataaaatttctactattgcatagttacagcatcattgtgtgtttaaaaaaatagcacatataactttgaaaactatattaccctgtatagatgccatagtgtgtgtgtgtgcatttttttttttctgagagggagtcttgctctgctagctcttgttgcctaggctggagtgcagtgacgcgatctcggctcacagcaacctctgcctcccaggttcaagcaattctgcctcagcctcccaagtagttgggactacaggcgcacgccaccacacccggataatttttgtatttttagtagagacctggtttcgccttgttggccaggctggtctcgaactcctgacctcaggtgatccgcctgcttcagcctcccaaagttctgggatgacaggcgtgagccaccatgcctggcctatttttaagaacaaattatctgacagaaataaaacctttattttttgacacgatatcccattttgtaacttttagaaacaatgactgctatattgatacaatccagtataaataagcaaatcaacctgatgtgagaaatgacagtcaagagtgtgtaaaaatgctagctaatggcaaatggcaaaatggcttttggagggtatgtaatgtagttaaaatttgattaaatgttctttggaattggataagagcatcgttgatcaatatgaatgacactggtaaaatgatatatgagttacaattgagagagcaaaatatgtgactaggaaattatcagaagctactaataataagctctttgaagtcacttgttaaatttatcttagagctttgatatccaaagaaatttagctgccttttatggatggggaaagtaagtgaaaaatgtttgttttattaaaggaagctcactgaaatgtttttgatatatttcgtccagagattggtgctatgcatatccatattttctaccatcctagcattcttagattgtcatgaccaacaatactgagcaaaggtaagaatcaagatacaagattcactttttggttattgttggagaataatcttgtatagtaagtaatttctaagataatatttgggttaaaatggcagatttaataaactaggaaaacaaagaaaaaaccaaaatgcatttcaatatattgaccttatccaaaggtgatagtgtagtgttttgatatttaatttacagaaatgctctgaaataactattgccatcctgctttcttaagtaaatggtctagaggtcgtaggagttagcccagctccactaccatggagcaagttaatttgtagagataagatttgaactcagttcaaataaggctctgaaagctatgttaaggcctctcactgccctccctctgtaagtaagaaatgtgaggaaaccaagatttactcattaagcatgcccggctttgatatattttcccagattagaggaacagatggctcttagtggtggtttttgttgttttcatggttattgttattattattgctaatgcctacctattttccctatcaaatgaatcaggaagctttgtccagtccctcttaattaaatgcagtgagagaaatgggatatcaatccaatacattgagctcagcttgtcctgagagtcagggtgcctagagaatatttgatatgccatgagttgcacagtgttataatgggccctgagttagtgttttgtgtatagtattcgtggtagagtcctgtctcttcccagataagtgtgtgttatataggatataacagtaagtagacataagtgcttgtttttattattagaaggctgataaggagcagagaacttgtggtcttagcagcccacattaaggaatgcaggttctatttaagtgcaatgataaatcaatgatggatttccaaacccggatgtacttttttttttttttgaggaaaagaaaaacctttgttgatgcataaggaaaggctgggtagaagaacagagttaagggtgggaggccagttaggagactgttgaagtaacgcaagtgaggcattatagtggaatggactagggtggttagagcagaaatgaaattacactctctgtatattgcagaggtagaattaatcaaataggacatctgaatatattagatggggtgagggaaaatggactaatcaaagacaacccttatttctggctataggaataggatattgtcattaactacattgggagacttcgagtacggagagtttttttggattgtggaaaattaagggttctgttgggagatgcacattagaaaactaagtgaacttgctaagtatacagttggagattaaagcaaaagagttatcagtctatagatagttagagttagtgtgtagacatctagtataagatcacctaggaaaagatatagatggtgaagaaaagaggacccagtcgcataccttaaagtacattgacattaagaaactcgacagagaaagaagaaatagcaaagaaacgcaaaagtgactgtgatgcagagatagaatcaaggagagatttgaggtttacttactatattaaatgtggagaatttgaagatgaatctaaaaaatatttgtctgttttctccgagggaatatttttatggttcatttataaagtcatctgtattgttttatgtgacaaaactggtttcattggttctttagattacttactgtcatttttggatttgaggtcataggagcccagaggggcaaaactctcagtaggaagcatcagtcgtgtcaatactgctgtgaggctgagtagaaagatgagaagtgagaactttttcttttggtgaccaacaagttattgatggccttgagaaaaatgcgactctggagatgtgtctgcagaagctggactgtagttggtgaaaaaatggacaggaaatgaaaaaatggaaaaaaaatctgtccagaaggttgactatgaagaggagcagagaaatgaagtataaattaggagaaggctaattgttcagggggcaaattttttacagtaggaatattatagatcatgtatgaaacttaagggactgatgctggagaaagtttgaagaggcaaaatatgcaaagaggaatgtttggatggtccttgagaaggtgtttgcgacagagtttgtagtctaagaagtgattgtccgtatctttactctttagatctcaatgttctcatctgtaaaacggtggagtagctgtggattatttccaagcttctttgtgacttgaatattctacaaatttattactgttagtcatgcatatgctagtaagcagtgatgaacatgggagatgtatcctgaggctgtttactctcatattaaaagtggagaatttgaagataaatctaaaagatacttaagtctattttctccaagggaatatttttatggttcatttatgaagtcatctgtattttatgtgagaaaactggtttcattgttctttagattacttatcctcttgtagaaactgtaactattttgaagtttgaggctgcaacatattcacattggtttcactgttttaatcttattttcactgcttttgccatctaaccataagatattggtgcagtaaggataattaagtaagataagtttattaacagcagcaagtatcttgaagacatacccatttcagatgtatgttaatgaccatattttttactctactatgctggaaggttttcgatggaattcccggaaaagagacttatagcagccatataaataacaattacagagagtattattggtatttatgctgaaatgccttttatattgtctttaatacttgagtagaacttaattgaattatatttgtcaaggtaactttttcctcttaagaaaaatcccgttgcttaaaattaaaaaaaataaacctagtattttctacctactagtaaaatgcaagtttacatattaaactcttgctttgcaaatgttaaattggttgaaatgagtcaaattggcaatttgtttgtaactagaatgtgtgtgagaagctgagtcaaaaatttgagaagcctccattgcccttttcaacttacatggtacttatttatgcaaaaggaaggcacatcaggtatgtcgtgacatgggctgaaacctatgtccatagaaccaggaagagttgggcatgggatatagctggttgatggaaactttcaagctgatatttcagtgttaattattgtcttcaatatgtacattgtttccaagaatcatattttgctttatcaaatggatgcattattatattttgttaatatctctgatccttttttgttcagaaaatggttattatctcaaaaatcataggatttgagaaagattacatgatataacaagtataaattgtagatcatagaacttggcacctagtaagcactctgcctcagcactcatgctcaaagtctgttaatgagatctgaatctggtggttttacagggtacaaaaccacaatgatttgtgaatatgtgagtctatggtagaatattaatgtggaaataatctggagtgcatacactgtgtgggtcccccaaaggcatgggtgattgtaggcataattaaccaaccttccttactcagaaagtggaaatggcaagttagagttttctaaaatataaaagcctatttaccagttctgtgatgagattttttttaaaaatccacacaaaaacaaaacaaaatgaaaaccacacatgatttagcttgtttggattgctatttgatgatatttaataataatagaaataattacctctgaacaaagttaattcagtatacattttgctattacttttctcttaagtaaaataatatctatcacccatgaatattttaaagaggtagctctttattctccagagtaaactatgtaaattcccaagaaccaataatttccataattattaaacaaatattatatcatagtttctgagcattagtcacagaaaaactcctgagattagattgagacaaagtgtcatgctttacgtttttactttacttggctaggattctcttattagaaacatacctattgtattattattttcaagcaaagaaaacaaaattccattgtaagttgggtcctttcacacttaatataagcaaaaactgtcattttttcattactgtaagctgattgaaaattgaaactgtgaacaatgtagctgttccaaataatagtttaaaaaataaaattatttttttctttgaatatatattttatttatcagaactcactaaaggattatatgtggaaagaatgttggtttataatttagaaacaacattttttagagatatttgcatttgcaacataatggaagttgatctcatagttgtaattgtcaataactgtctgctgtgcttgagactatatctgcccttgctcatttctcactctgcactcctggggaagtggaagaacattggccatgtctccttttgctgggcataagaaacatatataaatagatacgttataaatagatagtttcaagtaaataatgtgttctcttaagctcacaatgatgacttttataataaataatttctaccataacaaatgatttctttgcattattgcaaatacagatttcagcaataactgttttaggttccttttctaacactgtggatgagctagaatgactctctttgtcctctccttcagaggtctctcctgtcacctcctctttttctgtcttcccatttagcttaggggtctccattctataggctctctcacaccattgtcacagctgcactgtgatccaatatagacattctctgtatgatagcaactcctattgagtgccagcagatacaagtcctgcaagatgcccaaagaataaaagagatctatggtcaatagtgtagccatcttacagggtcaggattccattcatatattaaagtctttgtgagacttgcagtaatgaaacctgtgattaatctatacttccctaaattactttatcatgtgttttagaatagatatttctagtctgagaacctagttatattggaatagtttgggaaatgtcatgttactatttgaacgataagaagttatctcttcatttagaagaggtaacctagactaagaatgattgatatcacccatcagatttcatctgcttaatttttcagttctgtgcatttaacaatagaaagtttaaaacgagccatccttcaatgtgtttagcattataataaaagaacataggaaagatatagtctactgttctcattttacagttgttgaaactaaagcctagagagaggatattagttgaccatgagcacacagcttagtttaaagtagctgagatgtgagttgttttttgttttattttctttttgagacagggtcttgctctctcacccaggctggagtgcagaggtgtgatcatagctcactgtaacctcaaactcctgggttcaaatgatcctcctgccttagcctcctgagtaggtgggcctacagatgcatgccaccacaaccagctaatttaatttttttttgtagagatggggtcttgttaggttgctcagcttggccttgaactcctggcctcaactgatcctcccaccatgtcctcacaaagaggtggaattacaggcataaaccatgcacccagtcaagattgtgatccaaattcttattttccaattccaaatttagtgtcaagtctacaagttcaaactactttcattaaaagagaaccatagttacaataatcttgatagaacccacagctttttgtaaatggttttatttgtagtaatatttttctgtttgtaatatgtttctcgtgaatcacatagaagcgcagaagcattgagaaagcccatgaagctgggtttttgtacatttgtgcatatagcagattgaacccctcttttgctatttaatatagtgtgaagatttccccagtgctgtacttactttccaaaaacatgattgtttctttagacaatttcctattgttgtttccaaagttttgctatttaaaactgtattttaccaaacgtacgaaaaatgtaattgctgggtcaaagaataacaccatttctagggtttttctctgtaatgacaaattacactctaaagtgttatcagtttcattcctctcagtagtgtatgagaagacacttgtttattttttacaatcaaacatagtatcttcaaattgtccagaattctgagattactttctttactgttgactatgtaaaatagtaacttaaaatgctttttatgcctcttggatttctccctaatgtccctatttctgttgataataatgaagttttctatttatgatttaaattgccattattatatataaaacatctgtttgaaagtttaaataagatattgtgttaagctgaaaggtaatatttaaaaaaatcattgagcatttaccgtatttaacaaggttcccagtttatcctctcttcttttaaacctgactttctagtacttgagattttctttattctttcctggttaggttaagtatgcctttaactgcttttttttttccttgcataaaggatagatagcatgtcgaatagttggaaagaatttgtatatgagataatagctttctattgctcctatacattgtcaagtgatcaagaatatgctgggtgctcattcttggttcgtagttttctttttctcaaaagagtggagtattttcattttcattattttttggtgtctgattatatagaagtcaaatttgaagcaagtccaatttgatcaagttcttttaacttaatttttggatacttgtagaattttttaaatcttgaaaaattattgccattattttaataggatttactttttgtttcttcataaatctatttttatggtagctcttgagttctaaaacgtcagttttctttagctgaggaaagttatttttcatttttttctatggtaactgcacttgttccattttgctgtctttttcagatttctttcttatgtgaatttggtctctcagatatgtttttcgtatctcccactcacaacattttgtcttgatcctgctgaatggagctcaagatgaattcctgcagttttctctttcatttggctttgctaataatttaacttagtgtttttgatttaacccttggtgttttccatccaatgcaagcatttcatcttcatgtttacgtttcatatttcatagaagcaatatgattatatgatgaatgccaataaatatttagttattatagtatacaagagataaaggaaggtaacaccaaaatgtttttcctacaattgtttcaaaaatctattttcttgactgtccctgctttcctgcacttcttctcgtaggttcactgattttcctgtttgctcacttggtttcatgcatgttgtggccggaatgcatgtttactatggaatgcatctctccactgtgtttggcagcaactcgaaaccccttcatttagcttttatgctggctgtggctgtctattctgagggaagacttaaggggaagccctgaaactatcttttctgcttcttgtgattacttactgatggaaaaggctcccttgatttaacttgtgttggctgttcctggtactggcctttgccttacagtttaaggatgctgttgaatattaacatattctttcaattacttcctatgagtgtctggagataggaagtagttgaatgttggggtgaatgatagaccacccacttctgcagggttccttgtgggtcttcaatattctagtcctacagaattccttgtactttctggttcttcatcagtaccttttctagatacagaccttgatattgtttgttttgttttgttttgtttgtttgttttgttttttgttaaattggtcaatgccatgcaactgtggtcagagggactgaaattgttttcacatggctctcttcactggaaagccctgggttaatctgctcatgatcctttacatccagctctggaatttttttttctttataatgcataatgaatagctttgctaaagaggattctgctttcaaatttcaagaataaaaagaggacatctgtctgagtattaacatgatggaaatttttaaaaatatcacatagtgtgttagctcatatgtgacaaatagataatgcatctcatggccattaggaacagaatatttgtcagaacattctgtctattgtttaaaggcattggtgtaatgtcataatatttctacaaggtatgaaaatgttgcactgtgcatgtctgaagtctatagtgtatcccttagactcttgccatttagctgaattctgggggaatgttgccagtatcgttgtttcaaatgagataatcaaatggcttatggagctctatttacccccattccaccctctgtcacaatatagtaagttacttattggagcatatgcttaatgaaaaattaatagcaatgcaatatgatataatggtgcaggactatattctgactagtataagatatttacatatttttgccaattggtcattatcttttatttcacatatccatgatgagtgcatatttagaaaatgagagagtgctttctgctaatgtttctgattattagtgatagtgctgaattcatatgcttacagagagactgagagggagaagaagaggggctagaggaaggaggaggcaggagagaaaagaaagggagagagaaaggagggagaggaggaataagagtgagaatgtgaattgctgtgtgggtgggcctgtgtatatgcaacacagatgcataattttggaagtctgcattttctatatcatcattttggaaccttaccaagtagtgcaaatgctgtgatttagttgaaactaattatgggtacctctaaaatggtatctcacataaatgtctcataggcatgatttgaaaaaaaaataatttgttattattcttccttgaaagtcatgtatttaaattctttaataaaatgggtaaggtttctgtgactagccaagataaggctgcttacacttatgaatctataagagactatacatttcctcactcttgcatgctattaccagatgaatcattctattttgtatctggcgactcattcatctgctaagagaccttctgggccccacagtgcctgcagtgcacatggaagctctttaggctgacattcagggtctcctgtgatatggtgcctctctaacactgtatcgcagttgacagtttgtgtgtgctttggcctccagctaagtcaagccccttgccattctgagttatgactgtgggatttctgccctccgtgcctgtgcagggtcactatgggatgtccttcgcctccagccttctatgtctagatgctgtgcatctttacacactcagctcagatgccttctcctccaggaatggtcaccgctgaggcatcatagttgttctccttttaacatgtaaactgatggaagcctttaccttcatgtctcctaagacagtgaaatgtgaagcctcagctatgtatttggagggccccgaattccaattagcccagttatgttgtctttggtatgacacctaatatctcggaggctccgtttcttcatctgtgaaataggggtgataatatgcatgtcacagggcttgggaaaatgaagatgatgtctgagtcatgtgtagcacagtgcttggaccataatcaatgtcagataagcgcagcatactctatgatttttattaagtgccattgctctctcctataatgtgatttatttgtacgtaatgtctccctagctgtggggtccctcatatttgtctatatgtctgccccccaccccccaccaaaggcccaacttttttttttttttacctcaaatatgcacaaaattgagtctttattttagtactcagaagacagtgtaattccagcccagtttcttccattatttccagtacctctgagctgagcaggtctgggtgatttgtgagtcttcatgtgtgataatgtgtagcctctacttcaactgtcttctaggtggcaagaacttctggcttccttccctgaagagaccagctgaagtttgaagctccgcactctcaaagagcttgacagttgcaaggatattttcagtgtgataaagggcgtagtttccattggctgattttaagaagtaatacacatggaatgtgattaaacttgtgtcttctgcttatcaaacaggtggacttttaagctaatctagagagttgagctggttagcatttatctacatttaatcagatctaatgttggatagttctacttagacatgtttctctatatgactctagacattccctcctgtggctagaaatcaacctctttataatcctgcctcccaaactggccactctgattctaggaactttgtggtatgctgttgtcttcatgtcctcaattctccacactgctgtgtagtgtggaccagtggacatctcatgggtctttggagtcagacaaactgggccgcagagtcgatgttgatattactgaacacttctcagtcacaatgtcctcatctgggtaaataaggctaatattgtctactgctaggactgttgtaaaggaataaatgatgcacaagtgttatgtgataaaacaacgtgtgtgatagatagaggacccaatgaatgttaatcatctcctctatgctttctctccttttctcacaactaaacatcatgagaaataagtctagccaaaaggataagcatatatcttaagtagggcttcccttttacctgtaaacatcctcactttttaaaaaacatagcatgaaaactttgtgtgtgtgtgtctgttgcccaggctggagtgcagtggtttgatcttggctcactgcaaccttcgcctcccaggttccactgattctcctgtctcagcctctcaagtagctgggattacaggcgcccactgatttttgtattttaatagagatggggtttcaccgtgttggtcaggttgatctcaagctcctggcctcaagtgatctgcctgcctcagcctcccaaaatgttgggtttataggcgtgagccacggtgcctgggcggcaaagtgtttttaaagagaaatacctttttagattccaaaaatatttactacttgaatgattattgacagtaaacagccatcatttacgtgaaaggtaaaacatgtgctttattttattttttaaaacatgttcttacgagacctcaaggctcaactgacacttttttaaaagagacagtagaaattgaagaaaacgataaaatttaagaagaacgatttctaaaacttatcccaaaatcattgaaagaagtacgttggtgttttcaactaagttattttgaagaattgagatcattctagacaatcacagtcttggccacatgagcagttaaaattaatacaacatggctatgataatgacattttattatattaattacagtgaaaatgtattgttcaagaaaatattttctctaggagaggtcaggtcattttgtaaaaaatgttcaagtttgtaatgagactacataacttcttatgtttgtttctttgggagtcgtaacaaaaccttaagaaatgagatcttcattacaaatagattcatatgtgctcataagaaatcaatttcctttatgcctttaacaactagcagatgagaataaaatggaataaaactatggttatgctttaaagtactggcaatagttttaacaaatgagacttcatttacgtcttcaatatatgtatattgttaatttattatctctaagtaacacagaaattcatgtgagtccagtgtagtgggagctgagacacagggagtataaactgaatccagacacttgcttcagtcaagtatttttagatagttgccttagtcacatgatccttgtctggacagtattaacttcctttgctgatatctattctaaatgatacattttgggaacataatcatgcctaacccagcagtgaaaccctatccaaacatatcagtttgaaaattggtaaggaagatgctggataataaaatgtagatatattttagttcctaatgagctaagttatgtttctggttgtgttttacaaattattcataattaccctttgggaattagtttacctaaactttaaagaacacacatttccaattatcaataaaatttaagtagcatagaaaaagattgtatatacatttttgaattgatccttccagaaatcttatgaagtagccgttcttatgtccatttggacagaaaacaattatggtatttagggaaactaagtaatgtatcaaggtcatgtatacagctgcttttttttttccttcttggccacataatgtcattttggagttgtgagccatggggtaacattgtcaggtttgtagcgtagattaatttttctggcagaaatgtgaatggtcaatttgtgagatccaagactggaagcagggtcatgtatcacccttagctcctatctttccatcatagcccatgtcccacacatcaggaaagctgttagctataatttgaacatgtatcaacaagtcaacttacttatgtaaggccactgcctgtatcttcctggcttcagcctgtcaactccttccttcatatacagtagcctcctaatttattcacaaaatgctccaaaatgaatatattaacttactaaccttacgactgtagcaaatactaacagttgagtaggaaatttacttaataggcagcttgaaagaaaattcaagtcaatgcagtacatttctgctgcaaatcatttctgttgcaaaattactccatttgattcttgtttttcagtggtcttgccagaacaaagttgctattctgggtttgttttttctcttttaaaataattttattcaatttatgaatttgtttcagtttttaatagaataccctgacaaacattgtatggaaattccaaactaaaactaaacaaacattgccgtgttttcaactgtttcttttttatactgctctgaagaagaaaacaattctccctgaacaaattcctattacaatgaaggcaaagatcatgttttaaaaatatttactgccactatttgaagaaaacttctaggattgttgttcgggctcatacatttttaaaaaaggaaagtgtaagagaaaaaaaaaaaaaaagcaaaggaaaggctggtcatggtggctcacgcctgcaatcccagcactttgggaggccaagatgggcagatcgctcgaggtcaggagtttgagaccagcctggccaacatggtgaaattccatctctactgaaaatataaaaattagctgggttttgtggtgggcatccataatccccgctacttgggaggctgaggcaggagaattgcttaaactcaggaggcagaggctgcagtgagctgagattgtgccattgcactccagcctgggcgacacagtgagactccatctgaggaaaaaaaagaaaaagaaaaaaggggaaacgaggaaagaaggaaaaagaagagaggaatgaatgaaaatggaaaatagaggacagggaaaaataaatgaaagcttaccttactacgcaagtgccctattttctacacataggaaagctaatgaattgttagtcttgttttttaaacttggaaaacttaagtcactttttttgtactgatattttcctgatttcaaaaaaagttacccaaattaagaagctaagaggaaaatgtatttccagttaactgaaatattaagttgagcaatcatttcatataggatctgcgttcatgtaagtgcatgtaaatgctctcagggtagatgtatgtttgggacctaataaagtttcctcctctggttttagaaacaggttaggatcacaaaatcatgatacaactaacaacttcaacaatcatcctcctttgtttggagcccattgcaaaacctcttcataaaattgaacccatacatatagtatgatgcttgcaaatctgaaaaatccctttttggacaaactaactcatcttgcaaaacttcctacctggagtttcctctcagtaatccttaacaggaccaaacatccctaattgtataaactaaagaaaattaagactagcaagacttcacattgaccccagaattatttctaaagttgccaaatacgtttttgtctttgtgtctgtagcaaatctcttactcttgggacctcattacctgagtcccaggacacctcaaacttctctgaaaagccaaattgccttaccatgggcctgtcgagaattcctgtccctcttcaatatttgtcttacctttgattcctgttttattcaactttaatgaatcctactgtctcttcatggacccactatccacacctgtggagtctgggaacgttcaatgtggtagaaaaatgtaaaatttttatttatataaaaacagaagacttgtaattcagcagctgtgcagtgtttttctagcaactgtgtgctcttttgcatttggtacagtataaacttctagtttgttctgctgtcatggaacatggtcccagtaaaccttcctgaggtcagcaacttggaccttctgctgtctaggtcccatgcttggcgtagtgtggataataatgttaaatattatatggttttggcttcactgagccatatcagaacattcacaaatagctgtcatacaaattcctgcttcttattgccccttttccactgtgcatagatgcaagaaaatagtttcatggccaggtgctctttgtttcagcttcctttgtttctcccaaggctgcatggcaaatgtatgatttgttcattcttttaaaaaaaattgagtgctaagtgccaggcattatgaatgtatgtatgcttggaagagggggagagcagtgttattatctaactcacattttgaaaagatcactctgattgctttgtagaaaatggtaaggggtgttgaggaggggtgctgatgtgtctggacaagtaaaaacattccctagttgtgattagttcaaaaggaagcttaatagtctaagaaataaatgtaaggtattagtttgaaaaaaggtcatgctgattaattgcatgtgcaaggggaggggaaaagagaggggagatttcttgatttatgggtaggtggccttgtgtttagttaggaacactgggagaggaatggctcatgggcagaatcatgagtttggaaatattatgtttgaggctcatttaagatacacaattggagatgtcaaacaggcaactgaatatatttaatatgagccttgatctggataattctttagaggagttaaacattggggtttttatagaatataaattgtatttaacctagtttttgaaagcatctaggatagaatacagattaggaagaggatgggttccaggactgagcccagagattcctcaggtaaagtaaagaaagagaaggtaggactaagagactgaggagtgaaccgtgaggttgctggaaaaccaggagactgtactgtttcagaagccaatagattcatgcattttaagaatgacagagtggccagttacattgaaggctgtttaaagtcgagaaggatgcttggaatgtgtccattagatttggcaacatggaaattgctggtaaccaaaatgccagagaaggtttatcagagtggctgctgctgttgaagccaaagtgggagtgatctgagttgctgatgggagtgtctgttgacctatcttttgagaagtttggctaagggcagcagagaaatagcatggttgatggaggggctacggggtaaaggaagttgctgtgccttaaaaatgacaccttagagctgggtgtgttggcatgcacctgcagcctcagctactccggaggctgaagtgggaggatcgcttgagcccaggagttcaagtccagcctgggtgctgtaaggatacctgactgaaaacacacacacacacacacacacacacacacacacacacacacacacagataccttagagcagcatttattaaaccgcagtttgtgaaccataagtggtcttaaaatatttttattgggttgcaataatcatttaaaacattaattggagtaaaagagaaaatagggtacatgccatgtggtaaaggtaagaattttatttttgtggactatattattatgaagaatttacaaatagttacatatctacacacatatactggtgtatattggattgtaatataaaatgtatttcttcacgtgaattacggttttaaaatttgaaggccatcaaactagggaatgtttgcatgctgatagggataatctagtagagagaaagaaactgatgacacaagagagtgggaaaaccaaaggtgtaaagtccttgagcagagtgaagaacttttcacacaatcttctctcttttctcatttatttaccatgtggcttccaggtagtcatcatcaatctaaccgtaactgaacaaatcccatgtttctgcaggtatgtgcggcagtgctgatgtttttgtcaacagcaatgatttgacatcagcactgggctttggtttaaattgtttcctctctcctttttctaaatgtgtatgttaaagttctaaccaccagtacctcgaagtatgactatatttggagataatgtctttaaagaggtaattatattaaaatgaggacgttaaggtgggccctaatccagtatgatcagagcctgtatgagaagtctggacacaggcaggcacagaagaaagaccatgggaagacgctgggagatgatggacgtctgtgagccaaggagtcttcagaagaaactggctctgcttacaacttgatcttggacttctagcctccaacattgttgagaaaatgaattgcagttgtttaagccactaagtctgtggtgttttcttacggcagccctagcaaatgagtacatactgtcatgcttgttatttgatttggcctttgattgttacaacagcctgaggtgtggaggaccagaattataaatgccagtttacagatgagaacactgagatgaagagataaatgactgaccgaaggtcagggatcaaaatagctagtaagtgatacacaaagtgttgtagatcttttccaagtgttgtttccttggcaaaagccttggtggcaggccctgtagtcatggcctgcctgtagtggtagatatgactctatgctggtccattaattagtgccaaaagctacatttctctgcaaatatagattctagtgtgttctgaaataagacttacaacacttaaaaacttaaggatgcctagtgatgaaatatattaacattttttaaccatcacttttatgtagcccatgaaattatacagctcaataaacatttgaaagtttagtctctcaatgagaagtgataaaatttgacccgtgcatgaaaagaagacagctgattctttaaagcctttttgaagagctatgacatttctgtaaacatgcaccaaggaatatctgaataaagcaataatcgatcaactaacattgtgttggtttcctgatacaaacacctgaagtgaatgataccagtaaagttaccatccttttttctgcaatgctttttaggtcattttaattttaagctacatgctcttaacttgaattttaaacttcttaatggaatgtacttacaatgaataaatgctctgagtgacacttagagtttgcaacacgtttagcatgttgtgctgattcactaacgtacgctttctttcagattacttttactaagtaaaagtagtctacccttacactggtgaataagacaatatttcaaaaaattcctaaggtaacatagaggaaatgtgtattttgtgtgtgtgtgtgtgtgtgtgtgtgaatcacctttcagtataatgagaaattttatttcaccttatgaaaacacatgagtttttttagcatacaaacttaaagatcaaatttttaggttgtacgttgtgtctgtcttcagctgtgtaatgctaaatagatcttcaggttaccatcttatctattatgcatttgattctgttttcccacattctaaaatcagtcagattattgatttttacaatctaaagaggataatatgttagctgattattttcataatttgtgatttcctgattattagtgagattattagtgagacaaagagatctttgacatatttattggccatttgagtgtcttatgtcaactgtctattcatataactagcctgtttttctatttatttttattttcttacaattgaatttatccgttccttttgcatgttgtatgatactccattttacctgtgagatttgtaactatcttcttccaacctgtggctttctttttactttgcttataatgtattttatcttataaaaggtttcagtattaatatgttcaaatatgtttatttttcttttatgcttttttcttttctgtttctatctttatatcatcaatatagtctctacgtaataatttgaaagttaaatatttgtttacctgatttaagttattaatcccatcagaagttactttttttgtttttgtttgtagataaggagttatctgattttttttctttctctgtatggttagccggttatttctgcaccatgtattggatagtctatcttttgctcagacatttgtcataggctgtatcctaagctctcattggtacctgagtttattttaaggtcatttattctgtcacttttgttcctgtgtctattccttaaactatatacactgtttaatttctgaagctttttagtaaaggcttatatcaattaagctaagttctctattcattcacagcaaaatttccttgacagatactgatctgtaacttttccatgtatattttagcaaaaaattgccatcttccttgaaaacactaataggatttggttagaattgctttgattttatatatttatttgtaagaattgccttaaggacatttgggcatatgagcatgatatatagctcgtttgcttatgtctttttatggcattcaatagaattattattttaatctaaaagtcttacctacatgtttactattaatagatttagttataactgtcattgtgctattataaaagtaactctttaaaatcaaattttcttttttcttttcttttttttttttttttgagacagagtcttgcactgtcgcccaggttggagtgcagtggtgtgatcttggctcactgcaacctccacctcccaggttcaggtgattctcctgcctcagcctcccaagtagctgggactacaggcgcacgccaccatgcccagctaatttttatatttttagtagagacggggtttcacaatgttggccagatggtttcgatctcttgactttgtgatctgcatgcctcggcctcccaaagtgctgggattacaggcgtgagccatcagtgcccggcctaaaatcaaattttctaacagtttgctgcagatgtgaaggaatattacatggatatatttagtatatagaaatcttgctgaataattttatccattataatcatttatttattgattttcttagattatgtgggtaaatgtggataaattatataattcttaattcttttaatccttctacattttatttttgtgctattttactgtagtagatattttcaatacaatgaagactagaagttttaaaaccaggatagcaacctcatgggcctatttatgaaacaatacctatttatatgctacaactttttcacctgttatcgtgaatgacaattgacatctaacaatgggaaccataaacactgttgagctctaaatgctttcccagtgcattaaaaaaattaaattgactttctttttcattctttttctctacctctctcagaaacaacttctattatttactcattattatcttattccctaatttttttattttattcaacagatacttactgattgctcaccaatttgccaggcacagctggttttggggggcattccatgatgaataaaagtagcaagatcccatttctcatgaggcttctggattaacaagggagacatgcattatatagaaaattacataatggttatttccttacaatccgatggttactctgaagcacaagtgtagcatgctgtcagagtgcttagaagatcgggagggaatagtgctaatacatagtttggaaggtcagggaaagacatctgaacttgaccacactattgagtatgagttcgacaggcaaagatgggaccttgagcatgtagaatactccagtgacaagagtagatgtaaacaaaatagctctaaaaatagtgttcagtgaaaagtgatttgctataaatattacataggtgtgctaaatagaaaaatagaaaaatgattgaggacagcaaatatctgttgaatgtccctatttggaaggtatttaatatatcactctgaattgttctctggttaattaggaaaagtaagtttaaccaaggggagggcaatggatgttggtacagagctattcaagatcatggctacctgtgtacttgcctcatgcaagacctgtcacccattggaacttccatcattttttctctggatccatttctggtagtctctttattttgatctctatttttccttggtacccatgaggaacacaatttgaataaaagaaaaaaatgtattcataatttagaaaatgattttattggacccactaacatcaccaggaagaatgcaatgcaatattggcggtgggcattttggttaagactgggttggtcattttaatacaccctttcagccagtattcagagcaaggcatgtgcttgcctagacttcacattttagaaaagccagggcctatatatggagagttcttttttgtcagtctcatgaaatgaagtgctgcagtttgcatttttcctattcagtttcaagtatgaacttgattttaaaatttaactacagtttcgttaagatgtactacaactcccagctaattatgtagatgtatcaaatatgtattttatttaaaagccgtattactattttgcttttatccatcaatgattcttggataaaaggtggtaataaaatgttaatgtgtatttagtcatatgcaaaaaagtactatagaaatttctgaggtgtacaatgacatgcattattgcttccataagcgtaagaaaactcagaatgacaagtctacacaagctaggtttcttgttcatccaggggtggcttgctttgtaaccttttcctgaatagtagactaggtactgtcttccttttatttcccctataaattagttgcagtgttcttggggtccttagggacttcaggtggttgagcctttcaccaagcatacatacctagtctgtgaacagaagtctaggactctggaaagcactgagggcagagatgcttccagtcctgtccttacacgacttcccctgccaacctcctctcttccctcaggtatttttcttagtgcgttaaagatatttccttttacactaaaggaagtccagtgaaggttgcacagtgtgcagtggtgcacaaaaacaaaaacacaaaaaagggatgcatgcactctcaatagaattttacatggaaattgggagaagaggactccatctttctaggggacaataatggacactggccaaaagcagctgagtgagagctgagaccaaatccctgggatcagacctttcagccccagccatgcctcctttgggcatttgccttgtggaagactgacagctcctcagtcagtatagagggccagagacacagcgcagtatagaagcacatgtattatgacctggtcatgccaccaatatgtgagctgtgcttttctttgacatttttcattactcagtgaaagaagtagaagccatgcttgtcttttctctgccctggagaagtggagataacaagggctcagcctcatgagatctgagatgtagggcagactgtgtccacaatgcagaacttcagtgaataattaaaaatgagggcactttctaatggtctaattgagcacacggtgaaggaatttccaataagttatgtttaaccatcaagtgacattataagaagaaagaatttcatctttattttataggtgagaaagctgagccttggagtgggtaagccattggccaaggtcataaacaagtgtgtccaattccaaacctaagctcataatgagtacactgtgctgttgtaaaaggggccgtctctccctctttcagtcttaatgggagaaatatttaaaggcatctttgtgagaaagttttctgcaaaatataatgtggtttgaaaaatatgagttactgtgttaggttcagattgttaagactttcttttaatgtagaaggtgtagtgtctataaccattaatttgtgttgcaccctcccttttgtgaagcttattaataaaacagtctgctactccatcctccaattcctgtacttccagtgttcaagtctgctgatcatctactgcctaaaaagttttcccataaacaggaaaggttccagaagtgactttatcaacaaaaacgctgcttcttgctgctacaatttcctgaattacaaggcacagatggacattaattggagcgggtgttttgagagccagcactacctgcctcacactgctgagggatatagaggtctctattcctttctaagcacaggactcaggaagtattctggaagcagctcagaaactcagggtcctgcagggatgtgcctcttttggaagggcaagaaacctcactgatgaacagaagcccctcaacttcagattgcaacctcttcttgtgacacatgagacgcttcttaagatttcaaaacaaaacttggtttccagagggcagctagtgagctcatcctgtttggagacccaggctgtgtcttatctgtgtcaaataggtaatattttgacagaagtgtttccaactagcccacctcatacatagaatattgtactgcattggtctgttgtcatgctgctaatatagacatacctgagactgggttatttataaaggaaagagttttaatggactcacagttccacatagctggggaggcctcacaatcatggtggaatgaaaggagaagcaagccacgtcttaaatgataacaggcaagagagcttgtttaggggaacttccatttatagaagcatcacatctcatgagacttattcactattacaagaacagtatgaggacacccacgcagcgattaagttatctccatctggccccacccttgacaaatgggattattacaattcaaggtgatatttgggtggggacacagagccaaccatatcattccacccccggcccctctcaaatctcatgtcctcacatttgaaaacacaatcatgcccttccaacagtctcccaaagtcttaacttattccagccttaatccaaaagtccaacagtccaaagtctcatttgagacaaggtaagtcccttccacctatgagcctgtaaaatcaaaagcaagttagttacttcctagaaacaatggtggtgcaggcattgagtaaatgcccccattccaaatgggagaaattggccaaaacatagagactacagtccccatgcaagtctgaaatccagcggggtagtcaaattttagagctccaaaatgatctcctttgactccatgtctcacatccaagtcatgctgacggaagagatgggttgccgtggtcttgggcgtctccacccctgtggctttgcagcatttatccacctttccagctgctttcagaggctggtgttgagtgtctgtgtcttttccagatgcacagtgcaagctgtcggtggatctatccttctgggttctggaggatggtggccctattctcatggctccactaggcaatgccccagtggggactctgtgtgggggctccaactccacatttcacttcccacactgccctagcagaggttctccgtgagggcctcgcccctgcagcaaacttctgcctggatatccaggtatttccatacatcttctgaaatctaggtggaggttcccaaacctcagttctttacttctgtgtacccacatgctcaacatcacgtggaagctgccatggcttgggatttgcaccctctgaagccatggcctgagttgtaccttggccccttttagccatggctggagtggctgggatgcaggacaccaagtccctaggctacaaagagcagggggaccctggtcccagcccatgaaaccattttttctgcctagggctctaggcctatgaagggaggagctgctgtgaagacctctgacatgccatggagacattttacccattgtcttgacaattaacatttggctcctcattatttatgcagatttctcagctggcttgaatttctcctcagaaaatgggtttttcttttctatcacattgtcaggcagcaaattttccaaatttttatgctctacttcccttttaaacataagttccaactccaaaccatatctttgtgaatacataaaactgaatgcatttgacagcactgaagtcacctcttgaatgctttcctgcttagaaatttcttccaccagataccctaaattatatctttcaagttcaaagttccagagatctctagggcaggggcaaaatgtgaccagtctgtttgttaaagcataaaaagagtcacctttgctccaattaccaaaaagtttcttatcttcatctgagaccacctcaacttaagcttcattgtccataccactgtcagcattttggtcaaaactattcaacaaatctctaggaagttttaaaccttcccacatttttctgtcttcttctgagccaactaaactgttccaaactctgcctgttacccagttccaatgtcacttccacatttttgggtatctttatagctgcaccccactctaccagtaccaatttaatgtattagtttgttctcatgctactaataaagacttaaccaagactgggtaatttataaaggaaattggtttaatggactcacagttcctcatggcttgggaggcctcacaagcatggcagaaggcaaggaggagcaatcacatcttacatggcaacaggcaagagagcttgtgcaggggaactctcatttataaaaccatcagattttgtgagatttattgactatcaggagaacagtatgggggaaaccactcccatgattcaattatctccacctcgccttgcccttgacacatggggattattacaattcaaagtgagatttgggtgaagacactgagccaaaccatatcataaacttatatggcatatgatgggaaacttttatttttccatcacaagtagagtggtaatatatacaaagagaaaatgggtatcaggtattggcaatttttattttcattgttcatttacatatgaatttttagtataaatttggagactttaagtattcatgtcagaaaaaaatatttcagtgaataagtttcagaaattcaacgtcgtatgttttttttcttttgcaaggtcagactgtagattcctttaaaaaaggactttttattgatagaaaatgtgtttatagaattttaaaatagtatattctgttcattatctctaattttctcactctgctatactacatgcaattatatgtctaatgttatttatgtttatttatataaatttgctgttaaaatatattcaattccctattcctctaaaaagaacaaaaataatgacaatttattcgtattttttttcttggctatgaactcaaatagatgaaatgttatataaattaacaaactttaatagcacgtattggtgatgtgcaagtcaatagttctcaggcatttaccttcctagcactttcctatttgctgagagtagaagcgtttgggagaaatatacaggatagtacatgcttttcaggaactcacacctagctggaagggcatacctaccacagtggaaacagtcagagaaaaatccatcttggaatgtgggaaaatgattgtagctcttgaggaatttagaaagggagagatctttaggggctgggaaatgacaagttactaatatgtagactgggcagttcctctgtgctacttccataagcaagtgctttatactcacactgttgcatgtaaactcctcaacatttctgtgatagaggtactgtgagatgttcctttcacagaagaaactgaggccaaaaaagtaatgtgacttacccaaggtcccacctgtcataagtggcaggctcaggcctcatttacatggaattggtgtttttaaccatctctgttctctttgcagtggttgtaagtgcctcggcaataaaatagctaaacaccatcacagagtgtatagagttctcatgggctaggcattgtttcaagtgtcttttcttgtgttatctcacttcatcctcatataagccctatggatcacagagaattatgtgccttgcctaaatctgtcatgcaagcaagaaagatttgtgttggaattgaagaacgggcatgatgttgatgaacatttgggatgaggcacaagtgtttgaatgggctgatctctctgaaactggcagaggcagggtgaaggtgctggcttcaggcaggaaggaggccagactgtagggcagattctcatttttgaactaaaggcatgcagtaggaaacctgagatttattcagaggagcctagaaataacaggctagaaagaggaagggaggaatggagagcccttagacaattgaaagactaaattggccagcaaggaacagagatttcccattctacaatgggaaagaaagatgtggtctaaggtctgtgttaatgaagaaatgctggattctgcagtaagctttctgggagtctccactccataagcgggaaatgtaggaatttgtatgctttaatcaagtatatttctcaagaccacatcagaagtttttcttttgtagagtctgcattgaaatcatcatatagtttaagaaactcacttcgaggtagggacaacaatgttgtagttagcattgacttaaaatgtgagaagcgcaaatgtaaaaattcttacttgggttctctaaaaaagaaagtatgataattgattaatgtatgagcagatgaaccttcaccagattttgaaagcaaacctttggaacatgtaatgtatttgaagatacttttctagattttcccacaaaggatcttagtgaactgatcattcatacttcaaaatagaatttgagaataatactgtttgcaatcaaagttgggaacaaatctcatcaatatgattgggctttgtgtccccacccaaatctcatcctgaattgtaatccccataatccctataatcccaacgtgtgaagggagagatcaagtggaggtggttgaatcatgggggtggtttcccccatgctgttcttgtgacatatggtgaattctcatgagatctgatggttttataaggggctctttcctttttgctcggcacttctcctttctgccaccttggaagaaggtgacttaattgacatgtgagtcaattaaacctctttcctttataaattaccgcatctcgggcagttctttatagcagtatgaaaatgggctaatacatctgtcttcactatttactagttataaggctagtaaatagccatatgactgtatggcataatttaatttctctaaaccttagttttcttatctgtgaaatgggttaataatacctacatcatagaagttatagtgtattaaaaatagcacatgtaaaatgatgaacatgaagccaggcacatgtaagcaatctattaacattatcatcattttcattgatgttccctatagagacagtcatctgtggatttgatgcaggcaaactagatacctttaataaaaatatgaggtagttagcaactgcaaaggaaccttcttattcagagctattgttactgtcagcagtgttaatatattaattttgcttggtcattgactcagtgtataaaatatgtgggcagtgaactgaggaagcttagggaccagtgtgaaaaagacatataaatcatattaatgcagtagaagtgttataatcaagtgtatttttaatggaagcccatagaatgtgcttttactgtatggttagctgagtggttagccgattggagaagtgggcaggaaagtgacatttgagtctagatggatgagtaagagtctacttgaaagatgagagtccaaggaggttgcaaacagaaccctctctgccaccagaagcatgaaggtacaaagaaaatggcaggcagtaagcatgcgagatgttaactatggaaagagtgtggagtacaagacgagagaggcatgagctaaggctcaatgaggaagggcatcatttgttatatttcacatttatttgccataaaataggcttaggacaggtgtcttgatcgttaagtgcaaaagtcacatgatcaaatttatgtttcagcaagatgatcagagatgatgcaaatgaaaaattacagggagagaaactgaaaaaatattgttatgttttaagtgaaaagtaatgaggtctgcgactaggcaaagacatggaagataaatggttgggaattcaggtggaagacttttgggaactgcaagccattgaattgtttactgaatgtgggaatttaatagcaagtgaattatatgtccacatttgaccaataaaacaatagtgacatccttagaatcaagcaggaaatgcaaaatgaaaagcaggatttctttgagcatgtaagggaatttaattctcaataatttattgatttatttttattttttatactttaagttctagggtacatgtgcacaacgtgcacgtttgttacatgtgtatacatgtgccatgttggtgtgctgcatccattaactcgtaatttacattaggtatatctcctaatgctatccctctcccctctccccaccccacaacaggccccggtgtgtgatgttccccttcctgtgtccaagtgttctcattgttcaattcccacctgtgagtgagaacacgtggtgttcggttttttgtccttgggatagtttgctgagaatgacggtttccagcttcatccatgtccctacaaaggacatgaactcatcctttttaatggtggcatagtattccatggtgtatatgtgccacattttcttaatccatccagtctatcattgttggacatttgggttggttccaagtcgttgctattttgagtagtgccgcaataaacatacgtgtgcatgtgtctttatagcagcatgatttatagtcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatcttttcatgtgtctgttggctgcataaatgtcttcttttgagaagtgtctgttcatatccttcgcccacttgttgatggggttgtttgtttttttcttgtaaatttgtttgagttctttgtagattctggatattagccctttgtcagatgagtagattgcaaaaattttctcccattctgtaggttgcctgttcactctgatggcagtttcttttgctgtgcagaagctctttagtttaattagatcccatttgtcaattgtggctttttttgccatagcttttggtgttttagacgtgaatttcttgcccatgcttatgtcttgaattgcctaggctttcttctagggtttttatggttttaggtctaatgttgaagtctttaatccatcttgaattaatttttgtgtaaggtgtaaggaagggatccagtttccgctttctacctatggctagccagatttcccagcaccatttattaaatagggaatcctttccccattgcttgtttttgtcaggtttgtcaaagatcagatggttgcagatgtgtggtattgtttctgagggctctattctgttccattggtctacatctctcttttggtaccagtaccatgctgttttggttactatagccttgtagtatagtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcatcgaatctataaattaccttgggcagcatggccattttcatgatattgattcttcctatccatgagcatggaatgttcttccatttgtttgtatcctcttttatttcgttgagcagtggtttgtagttctccttgaagaggtccttcacatcccttgtaagttggatccctaggtattgtattctctttgaagcaattgtgaatgggagttcactcatgatttggctctctatttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaatcgaatacactttttttctttctcctgtcttattgccctggccagaacttccaacactatattgaataggagtggtgagagaaggcatccctgtcttgtgccagttttcaaagggaatgcttccagtttttgcccattgaggatgatattggctgtgggtttgtcataaatagctcttattattttgagatatgtcccatcaatacctaatttattgagagtttttagcatgaagggctgttgaattttgtcagaggccttttctgcatctattgagataatcatgtggtttttgtctttggttctgtttatatactggattacgtttattaatttgtgtatgttgaaccagccttgcatcccagggatgaagcccacttgatcatggtggataagctttttgatgtgctgctggattcagtttgccagtattttattgaggatttttgcatcaatgttcatctgggattatgatctaaaattctgttttgtttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggaatttttttggttggtaagctattaattattgcctcaatttcagggcctgttattggtttattaagagattcagcttcttcctggtttagtcttgggagggtgtatgtgtcgaggaatttatccatttcttctagattttctagtttatttgcgtagaggtgtttatagtattctctgatggtagtttgtatttctgtgggatcggtggtgatatctcctttatcattttttattgtgtctatttgattcttctctctttttttctttattagtcttgctagcggtctatcaattttgttgatcttttcaaaaaaccagctccttgattcattgattttttgaagggttttttgtgtctccatttcctttagttctgctctgatcttagtaatttcttgccatctgctagcttttgaatgtgtttgctcttgcttctctagttcttttaattgtgatgttagggtgtcagttttagatctttcctgttttctcttgtgggcatttactgctataaatttctaaaggctttcaaagtaaaaaatttgaattatagcacaaatgtgtcattttagaaaatgccaggtttataggaaaaagttataaattgtaaattgtgattttatcttactgtgtcaatcagaacagagccaaagatgtggcttgcaatttactttaagaaaagaaatcacatatttgtagaatattttgtaattttcacttctcctttccataaactgccttgtttaattccttgaagagtctcactattctttcctttatgagggttctacaaatgtcccttaagcaaacactaggtataaggaactgtcctaggttccggaaacacctcactctcacagaggatacattctagggatagaataggggagttataagtatctagaatagaaagtcttaacttgggccctgagtagtatttggggatagtgaggtatacacgatctcaataaaatttacgtaaaatagttctaagaagagacttttaccagatttcaaagactttcataatcctaaactggttaagaatcatggttttcaaagctgagcctcaaagaagttagctgacttgctcaagttcccaagaatcaagttacaatttggatcttaatgtactgtgcagtgccattcaacccctcattgctaattgtcttgccatctttatctccaaagaatggtcaattttcctgagttctaatacattcctcagtttacttattataaatgtcacttccaatccggttgcagcaattaataattttgtaatatagctggatcgactttaatttcttttggctttaagtgcagagacatccaatcctgctagttccaaaggtgttttctgaaggcagtgttcccaaatcactgttggaaaggaatatggcaaggctcctgaagaaattccggtggaatttctttaatcatctggtggaagtggagatgtgtgtggttcctaagaatattgtgagtcctatatttaggacacagaccaatgcctttgaaatggccttcttggcttcctgcagtgtggagctgtgatctccatggtgagatatcccttatatttacacactgccacctgacctttgggtcagggcatttccaatcgatttaggagtgcagcaagtgcaacgacggtgttgatgagctcttacagcatggtaagcaaggctgcctgggactgaggggcgtgggaactctattgatttttaggtactttttatcacatactcctacactgctggactttgaattaagttagttttcagacaacataccagagggcaagaaaacaaaaagtgggatttttacacataccctggaaacaagttaatttttcctggggaaatcaagtagagagctggttaccatcttagcaattaacagaagttagacaaaatgtttaacaggaattggctttgtggattatggcattgggttaccagaacagcaatcaaaatgcacctcagtagtctcagtttgttagaactgtgtctcacttcaaatataactttgctctggaagaatagagagtctcaaattcacttgtgggatcctcaagaattttgcttctctgattgccaagcattgaagcaataatttgttattgaattgaagcaagacaacaggaagataattttatatcagcctgatggcgttgtttactgaaactctaataagcttttgggcatgtagtatgtgtgtgtgtgtgtgtgtgtgtgtgtgtgtgtgtgtgtgtgtgtgtgtcttgatttagggttaagtcttcctgatttgaaggaataattttaaataatattgtcagcatggccctgtgattcaacatctgttgctgtgttttttcctaaattccagtcttttgtatacacttagaaatttggatgatttacattggatgcttttttttttctgctcacttttaatctttacagtattttctgaaaggcagcatcaaattctgaatgggcatcactgattcatttacacatctgttaaaattttattgagcacatactatgtgtggtgtaatgcactactttccaatgataaggaatttagataagcaaaatgtgcttcaggtcgtcaggccacggtgattataatttggagagactgtaggtaggcaactcattacaaatgaagcagaatgaaactatcactaaattgagtaggcaggaatagcttactctggcagaaggcacctgagaatcctaattgagggaagacttttaggttttaagtaagcaaatccaccactgggagaatgacaaaccctgtcagtcacatgcctttattatcatggctctgctttcagtacctcccggttgtgatatctgtactcttctctctgctcatccaaaaagtctgcattatttcatgttaagagaatagtttgatatttactattggccaaagcaagaaaggctttgcctactccatgctatagcttagtatttgtggtgtttcttcattattggtgtacttctctacaggatttctttatgatggtttctgtctttagatactgacctaaattattacttgccctggccttttggggaagaaagtcataaaatcaactatgccttagatctgcattgtcaaatcggaagctatcaaccactgtggtcaatgagcacttgaaatttactagtcccatttgcaacatgctgtaagtggaaaaaacacactgagtttcaaagacctggtatggaaaaaaatgtaaaattttatttttatttttatagtgaatacaggttgaaatgctgagaactttatacatatatctatttaactatacatatatttaactaatcaattttgatttattatatataaaaattatatatatatttatggggtacatgtgatattttgaaagatacaatgtgtaatgatcaaattagggtaattaggatattcatcacctcagatatttattctttctttgggttgggaacattccttatgttctcttccagctatttcaaaatataggttaaatttattcataagttttttttttgttatcccttataaatgtgattgctctcttgatttcttttagagattctctgctgttggtgtattgacctgatactgatttttgcatgttgattttgcatcctgccattttactgaattcatttatcagttctgctagtttttttggtggagtctttaagtttgtctaaatataatatcatgtgtgaacaaggataatttcatttcttttttcacaatttgggtgtcctttatttctttcccttgcccaattgtgctggctggaacttctggtgctatgttgaataaaagtggtgatggcaggtatccttgtcttgttccagatcttataggaaaggcttgcaatttttccctattcagtaagatgttaactatgggatttttataagtggtctttattattttgagatatgtttcttctgtacacaatttgttgagagttttcatcataaatggatgttgaatgtaatggaatgctttttcagcagctatgatcatatggcttttgttcttgattctgttaatgtcatgtatcatgtttattaatttacttaggttgaaccatccttgtatccctaggataaatcccatttgattatggcaagtcaatttttttaacgtgttattgaacttgcatgatggaattttgttgaggatttttgcatccatgtccatcaggagtattggcttgtagtttccttcttttgttgtgtctgtgtctggttttggtatcagggtaatgatgggcccatagaatgagtttgaaagttccccttctcttcaactttttggaatagtttaagtagaattgttattgcttcttctttaaatgttttgtggaattcagcagtgaatctatcaggtcttgggcttttctttgatgtgagacttttaattgtagcttcactctcattacttattattggcttgttgaggttttctatttcttcattgttcaatcttggtaggttgtatgtgtgcaggaatttatccacatttttttaggtttttcaatttgttggcttatggttgttcagaatatcctctagtgagtctctgaatttctgtggtatcagttttagtatctccccttttcctctggtttcattgaattgagtcttgttttcttaattcgtgtagctaagggtttgttgattttgttcatctttgcaaaataacaagttgtatttgttgatcttttgttatttttgtatccttaatttcattttttctgctctgatctttattatttcttttcttctactaattttggaaaacctttatacagtgggttaaagaaaatatcttattaataattaatattaatttcacctgtttctttttcctttatttcacatggctaccagaaaatttaaaagtttacatgtggttttcattatatttctgttaaacagtgctgcctaagatagtgcttatggaactgttgtcacaaaacttatgtataagtgggttaaccgagataataaagctgaattcaaggtgtgtagaatgagcactagactgagatccagggactgattcagtcccagctaggacttggtctcctcaggtagccattcactctacgtgtctggaatggagtgcactcactgaaaaaatgcggaaaagattgagaagtagatcatttctaacccccttcctacattaaattcagtgattcaactgtgttcaggagtatacgattgaatcatacttgtagccctcccagtatcttctcaaagccttttagacaaaaccgtcttcctcattccacatcataatttatttgagaggttaaatttgtaattactgtaatttggagcttccttgatcagcctgaggctggagcacagcatccttcaatctgttcagtgctaagtgaatcagttgaacatgttgtgatttataaggatctgataaatatgttttgcaagaaagtttccagcactctttgaaaaaatttagagtgttctgaaagtaaactgtagtttttatgtcatttcaaataattaagaagaaattgtttcttattttttaaattaatattgaaaaatctatttctaacttaaattcacaggtaaaaaatgtggaatacttcatatatttcttataatattaaatatcttattaatattttatatcttacactttgatataaagaaatataagaaatatatataagaaatactctagccatatctgacttttttccatgtacgtatatttgaatataatatagattgtagtgtatatgttttagttttttaaaaaagttttaacatgtgttctactttggaacatgagtaatttataatattttttcttataaataatagtatgtttacatgtgcatatgcctgagataattagtttaggatcatttcttaatagagaaatgctggtcaaaggacataaatattttaagattttttcatatttataataaactttccttccaggaagtttgtattttccatttgtgtttcccttagcagggactgcctgttccctgcaaccttaccaatactaaaattaagattttaagttttgttttggttgacgagtgagaaaacatactttatttttgttggaatttatatttcttaggttactaagagaatccaaaattatttaatgagcatattggcaacttctaattcttctttgtaaatagcttgttttgggtttatatcgtctatttacttacttattttggatagttttttgttttgttttgttttgatagctgagctggtgagattatatagcacccttgaaaactttcctctttgctctgacttccaatcctgttcagtcatagacagccctgcccctgctccatccacatgtcacctgagcaaacaagcatatacaacagggggaaatcactgtagtcctcatcttggcatgtgggttccagaaaataatcaagcccttataagaggaagaagataatttaactcccatttggtccttatattggagtcttttagagcaattttttctagtttttcctttccaaagcaaatgaaaagaccccataacaatactagctttaagatctctgctgtaaacaaggattctgagtcaattgggataccacaggttagttacgtgtacactggtgtatccccttgcaaaatcacctgccttgagctgtcattacagaaccattataagaaagggccatataaaatataaaatattttaataaattggttgtgaaaatattgttatggacactgttttgtataacactgacattccaatacacaaaggatgcattataaaagatggagtgctagaaaaagctaaagtgctcttcaggtttatcttgcttctgatacgtgttactgatgatgtttcgggaattgcttgtctgcttggaaactcagagccaaatttgattcttaatcacagcaataatattggctgttagtattgactattttggtaatgtatttttatgctccaatttatatattacctataatttctgatttcattatttggtaaatttttttgtgtggatttttgtgtgggtgtgtttgaattttgtctgtctgtttgtctgtttgtttgtttgtttgtctgaaggtttttggaaaccttcttatttctgaaaaagagcaaggcctgtgattaagaagagtttttgcaagttcagtgaatactgtcatcattttcataataactttaaggtttattacagaaaactagaatagatttttgcctcttcctaggcaaaaaaagctgttgttcccaagcagaaaggtgaaagtcatcttgtattatttcttggcttttcatttttatatatgtttgcttgccttaatgataataatgctctaatctaattatcaatcacctgtttaatgctattatttctgttaattcatgggggcagctaatgattttaaataaggtagttttcacaagaataagtgaacaacatgaaactttttgtcaaatcaattttctaggcatcctttattttctgggcatcctttgggtttattcagtagaatagtctttggaaaatttgtaaatcatgcaataattgaaataaccaaaatactgtctccttatacacattttacataggaatatgctttagaaaactaagcaaagtataagtaaagggaatattacagaaaggtaaatgtcagtgttcttctattcaaattatgggctttaatttccccagccttttggtggtaagtgaagccatccttgtcttgaaaactgtagggggaactgtttacatggcctactttagacccttatgttattctgagtttttttcttctccagggaaataatttttaactatgtttgaaagaatgaatttaaggcttattaactgaactcgtcttcaaaaatttagaaacgatggttctgtcaaatcagataattttcttcctgtgcattaaagcataatatgaggaaactattagctacaaagcacatttaaatgctgcttggatattggtgtgcccttgctcattttcttgagtgtttctcaattcaaaactcaaaattaactgcatacttggcatcaggtcttgccatcaggttgaacctgagctgatgtcaatgacacactgctttggagcccatgggtaggtgaggggattgcagtctctcttcagtgtgggattctgaaaagaggcaaactgatagaggctccaaccaaataactgtacccacacattgagggactgaaggtaaactcccagagaagagacaaagacaggaggtggagagcagaatagtcaggaaacaagttagtcacagactttactcagatccgggttgtgcaagcaatgcagacttgactcttttgtcccatccactactcactgcccactgcactctttttggctgggttgtattattaactgctgggaatatttttctcaacttccattagagtggggattctcatatgagtagtagtaagtagaatagtaggaagtaagtaagaagagtagtaagtgaaattctgaagtactacctcttcctgcttttttctactggccttaaacatggatgcaatgtctggaactgcaatgattatcttgtaaacatgaacaagagatgacaccatgcctaggaaacactgaatttctgcctgcttccagacttctggtcataggaggaaaaaacaaaacaaaacaaaacaaaaacccccattagaagtcaaaatttctgctacttgagttcaaatgcattcctaacttatatactttgttgcctcgtttgttgccttctgctcttcaatagtctcactctcattggggaagaaaaatatataaacttaaagttcttattgcgacacttcttaatacctaaaattgccatcctgttgagccaggatgatcctcacatatgaggtacttagtagttgcttgttgaatggatgtgaaaaatattcctgtttttcactttggccaaattgaatgatagaaacgctttgggcttctctgacctggcagttccacagtgcaaagcaacattctgccctcagatcagcacacatctttacttatacaaaccctcactctggggtgcttattgttatagaaatctgcttctgtttttggcttccctgatggaaggaaaaggatgcctcagttcctggatgtattgtatgaaccttggctatacttacataaagcacaaaataactaagaaatatgctcaccccgtaaggatttatgtggagctcactcacaaatactttcataactgctgagaatcagcacggtttggtgcgatgttgaaaagtcatcagaatcaaaaaactatgtgtccaggtgcggtggctcacacctgtaatcctagcactttgggaggctgaggcagatggatcacctgaggtcaggagtttgagaccagactggccaacatggtaaaaccccgtttttactaaaaatagaaaaattagccaggcatggtcgtgggcgcttgtaatcccagctgctcgggaggctgaggcaggagaattgctttaacctgggaggtggaggttgcagtgatcagagatcgcatcactgcattccagcctgggcaacagagagagactgcatctcaaaataaaaaaaagaatcaaataaactctgatacccatcgttaccaccattggctgtgtgctgtggagaaatttagttaacttttctctgaagaagtattccttcctttgtaaaaatagacataaatatgccagtttcccaaagtgaatgggattaaattaaatcatgtatacatatataaagtgtttggcatgtagtaagggattaataagtgatacctgttatattaatggttgtggttatcttgcaatatgatagttgaaagatgtgctgattcaaagctgtcaacccaacatcttcctgggatctcacctgccttgctgtattatctgctggcgtctccaagggtgaccagcttgaacgatttcattatgtgtcactactacaacattttacacaaatacaattaaacaagttcgtcttccagcacactagttgggagttaaaaacagtttctattgatttatatttttgatggacttcattgagaatgttctgatttgtgggttaatgctttcttacattgagggttcccaggagccctgcagtgaagatggtaacctttacctaaactcaccagaatgattaattaatgtttacctctaatgagctaattaggagtttgggacattttggcattttgaatggcttacttgattatctaaagggaacttttaccatctcaagaggaattataattggccttagggaataatagaatcacctaaagtataagaaagcctccctcatgttggcaaacaacctgtctaacaaatgtcccctttgacaaaacagcccgcagtcacaaatacgagttgaaatcgtaaggggaactctgacaggatttacagttacattaattgctcgctcttggcatgggtgatttttgtgattagaagaggatcagagcagctttctactcaagtctttggcttgaggctgatcattctccataaacaatgacacctttgggagggcagccaaaaatgtcccatagagaaatatcaggagagattcttacttaatgagatatgaataaggctgttgagctccaccagatctttgcttgtctccttaatgaggaaacatcacagtgggtgaagtggtgataatgttaataaccatgatccaattcaatgaatggtggaagtaaggagagaattcaggaaacagacgtaacacaactctctatacaaacctctgggtcagttatgtaacttgattttatgtttatcttcaagtgagggagttagtgcgcctggcttatgcagtagttacacataagacatgtagatggaagtctaataagtgaaggagactaaatagaaagtcagatgtacctcagggagaaaacgtgattcataccaaaactcactctacggagtgagagagctactcagcactttaatggaggatatgatcaagacttgattttccatttcgttttcctttttggaattatgcacttcccaacagaaatgtctaatttggaaaaaaaaaaaagggacctccactgtcaagttgggggaatgagggcaggaaggagaaaatgaatataaaagaaataaatgaaggacaagtttgcaaaaaataggttgtgcaagaaccaagaaggtttaaaacaacgttcagagtaatgagctcaattcactaggaatggggagttcttgaaggaattgaagcaaggagattacctgattagagataggttgcattttaggtaaaggtagaaataattattggaatttagaaaacctcccaaaatacctgattataaaatcaaagttattatctagatattcaagtattaaataacttttaaataacctgaaacacatggatcttcacatatgtgaagaaagcattttcccagccacattcattatccgtaaaacattttacagtacctgtcatagaagacccgtcccatttatatataaagtttcatcggtgctctttaatgtcacattattttaggtatggttgtttcaactgagtgcacacatctattagtgctaagtcacattggataatgaagcactgttattcccacgaacctgtgttaggtggaccagggattttaattaaatatctgaatgagtgttgtaaagtggatactctctagaaagcatctgtcagggttaatactttacaagttagctatgcctctttcaacctttaattataatattctaactctttatccttagttactgctaataatttcaaggttatacagatagaaattacttgattatccaagtgcctgcacttatcgaatgaaatagaaatcaatttcactgtacatggtttataagtaagcaatgctaacatattattgtatttttctaaaaaaattctttttttaacaaaaggaattgaaaaccacatgatatcctgtggttgaaagtgcctaatgcctgccacatatgtaacaaaagtaaattcttaataataacagtgatagtcctcctgcatccaataaacaaacgcacttcttgatcattgacaattcttcagctctctttaagcattgatctttagtccttattaatttctcatagtgtcctgcttggcccccataagtccatttcatcatttaagtatatggccttgccacttccttccccacaagtagactttggccatttctatggatgcagcatttagaaaagatttgctttagcccttaattttcagaatcataaagcacatcaataattttttcacctccaagccaccccttcacaccaccttcatgtgggctgaccaagcagtgggccattcaggagtcaggcagttgctgttccttgttaggagaagtagaaagccatgaccccagcattgatatcaaatcttttaaatattggttatggggtattttgacttttatcttgtttgattcttttttttttttttatttccaatcactgttttgataaaaatgtgttaattatatgcttctgtttaagagtcatgatgttactcttctgttgatggacctgcaaacttcatttattataagacaatgagaagttattattctccctaagaaagctagcttagcattcattttaagaatactgaagaaaactttgattctctaactagaaaagagagattaaaagtatttaaaagtacaaaggaagttttttccctctcaggcctctcttggttcctggtttgttgttgttgttgttgttttttctaatgctgcttcagttaacaatgccttgtgctggtatgctattttttaaatgcaatggagggaacagatagatcttcattcttcctaagagtagaaaattctcattatggagactcataatcttcaatatttgaagactatattcacaccagatcagaataatgataagttaagcagaattgaaacatattgaaatcatatttgacactggaaattctttaattctatgagaactatatcattatagttctcattttataagaaagttatttaatatattttaaggatgataatagcacattgtgcgttaactttgatgtctctttctttgacagtttggagactacattggcttgcaatggagaataaaatctcaaccatattaatgggatcatcttttattctccaaggcctaagtagtttccagggcacatgatgccccttatagatcctcatttgtccttacagtgtcttcattctggaatgtgtaactaaagtaaattccaaaagtaaatgttaaagaatcatttttaaaaccaagtaaaataatgaccctcatgctgatataaaatgaacacatattaaatatttaactcattaatgtaggaaccaataagatgttgtaagttcaaaggagaattcaaagaacagacttaattatagattaggaatattgaaaaaaatgtgaaaattgaaggaaaactggcctgggccatggtggaaaaaggaagccaattgaaatcctgtcagacagaatgttgcatttctataggaatattattttttgcattgctaatggctattgacaacttacagatttgtaaaatggctcaatgcaaggttggaatgagatttcctggaataatgtaccgtagacaatgcagttttccctgaataacacatttttcccctacagtacattgttccctctttattggataactagtatttaccattaagattttgctcaagcatgtaccataagaagccttccctggtaccttctgtctgtttttaggtttccctctacctctcaaaatagcttataaataacaatcactggtctctatacatggcattataattccatatttatgatttccctcagtccttcttctttaagaccagaactatacctttttattttatttttgcatagtatttgtatagtgttagacacctagacaaaattgacaagttgcctacagaatgaatgagtgaatgaatcaagtagtgatggatgtatgcttgtgtcaaatttacatgagcatgtgtgataggaaaacatttgtcatgcaggatgcatcagggatttgagcatggtccctttaactctgagcattgcacagctcatatcattactaaattaaactctatgcttacctgactttgctacaaccttactctctgatcccagaaaaattctgtataccttgaaactaatttatattagtgaaatacatattctttattcttgcaaaactgcctgtgaaaatgttttttaatcataggtcatttgacattatagtaatatatttgcaaaagtggaaagttttgcataagcacaagtaatgatctttaactaccttagaaatgatttaaagtaggtggtcaaagaatctttacttttctggtatttctggcattatggcaaaagcaacgaagcaagagctagttccttctctttacttccttcctgtaatctttgcaggttctttgtacatgttaggaaataaacctttattagttgaatctctaatctgttagtacattttttaaattacttagcattaagtctataatgagtagacagagaccatatacatgacccattatttaaaggttcttaaatttcagatatgtttacacaaaattgtgcttcttccgaatccttatttcagatgattcttgtttgaatatatgttggcacctgtatgttcaaaacagtggaggtgtcttggaaaccgcaagatgcatcctgcaaaaaggtagagggtggtagagagtgtcctgagttttaaataagtagatttttggatttgaatttgagctctgtcaatttctatatgcatgacctgaagcaagctacttaatttctttctatttcattttccttatatctaaaatgagaataataatcctgatttcatagagctgaggtgagggtaaggcagacaatgaatgcaactgacttatgaaagcaactggggaatgcattcattccccagccattccctggagtacaccttgttttatctgcatttgttcatccctgtttcttactccttgtcagtcaccaccttctttaaatccttcatggttgagcttaaaacccacccgttcctgccttgttgattggtttttcttgtcactgccaagtagactgtgggctcagtgagagcagaggctctgctctgacttgttgagagaccccagagcacctcctacggtctggcagcccacacccagtggactaaaatgcagccctggcaccatctttctatacttcttttctcagaggtgttgcctcattttgacctgtgttctctagaaacccaagaaattttctctaaagaacagacttaaagtgaatatagtttactccgtgctgttcatggttctgaatagagttggcgcatatatagtgggtttgattttctttaccaagctgccctgtagttcgagcagcttgcacatatgcttccagatagactcgcccagcatgccttccagaatccaatacagcttcagaattccagagagtgaggactgacctagggtcaaatgcattaacctgctccatcaccaaaatgctgctggaggattgaacagatgtgtgtcaatgcttgtggtatcagtaaaacatacgaaaacatggatttattttaactccctgtggtctgaagctgtaaggtagagatacaaaaattcatacactgtgattttttttgctgttattttcttcttcacagtgtatttattccttctgagcatctttggccatgcactgtgttttctttaatgaaagtagaaaatttgtatcctcattgcttatttttagcactgttgctatgataaactgtagcctaggcatcttattaaaatcaattgaggatttgaattattattccctttaatattgtggcattactattctttctgaaaatatttcaccatgtatgaatctatccaaatatttcctatgacttactggaaagatatttctcatctatttaagggatatataaaaaatagcctcataggggttggggacaaatgtttttgttttcctctggattgtttttgtgggaaagtgttaggtgcaattatttttttcaatactctgcttaagaataatttgtaatatctttaggatgaagttgcatagtacaaaacaactttttgtgaataaagtaattgacaattttggttttaattaccacatgtcatgactagtagacttcctaacaaaacacatagattgggcaacctgaatttttctacataaaaattgaggtcttacaatatcatgaggtcttacaatatcagtgaagcaataatctgcattccaagactttatgctgtttcacatgtgtaaatagcaactacagcatctactatttctgccatggagtctgggactgtttcaaggctgttcatctatgattttcattctcagtaccaggatcatgggcaggaatggagcttgaagagatctgggcccactcacaagggtttttaagaatcaggagatggtaattattaagaggaggtaagaactgagttgaacctaaagggtcgacttatattttaggctgttagaccagaattatacctccctttaaactagataaacatactagcataaaacaacctgcagtgatgaaggggaggccattaaacccaaagagtcctagttctaggccaagtgttaggctatctgctttcgtaagtacatcccatttaatcttcctaacaaccctgctaggcacaagttattatccccatttcacagatgaagaaaccaggctcggggagattaaataacttcctcgttgtaaggggttgcactggcatttaagcttagcccttatgattcaaagcttatgctttatgttatatgatgctaaaataaaggcatggtttttttcccatggaagaatatccttcatattttttaaagttgtagtaagtagcacataaatgagacctactcttaagaaattttataagtgtatagtacagcattaactataagcacagtgttatatagcagttctctagaacttttgtaacttgcatgactgaaactctatacccattgaatagaaactctccataggtctttacatctataactaaattctgatcacccattcctgtcccggcactgcttatttgtttgttggttttgttttgtatagagggggaaaggtgccacattaatgccgagttcaaggtcactgtttaacgaacaggtcttggggtagcaattgctataacatgtcaatagccagattcaccataaaggtgatcagactactaccacgctgttttattaatcactgtatgaatttgattataatttataatcaccaacatagtttctgttccatttaggtgacagactgttgatttactttgaattccaagatgacagtgcccctctgagtcaggcagggtatattttaagtcacagttacttgagaagtccctccccaaagcagatcacagacatcacttcttcatctggttgagaagcttctggatggagtcagactgcctggcagatcctggctgcactccagagaactatgagcactgccagacagccccctggcactagggctggccaaacagtcatggcacaaggatcctctgtacttttactgggcaccaagcccagctccatcagggcagaatgtggagctcagcagtttgaagtctggtctccatggcactagggccaaaggcaagctacagaaattccaaggcaactgcattgtctctggtgtaggcacatgacacattccacccaaaaaattaagagaggctgtatcctgtccctgatccaaggtaggaagaaaattctctccttttcccttctttgttcacattattcaaattgctttcaaacggtttgaaaaatcgatttttttctaataaactcatggtcttttaaacaggtctaacagcattggcaggatctcatatgaatgagcacagtactagaagacatcacgatgaggccttattccaacttcaggttgcagtgtgttttcaacatggcacttaaacttggtgaacctcagttttctcttattttaattacaatattcatggcatctgcctcacacgggctttccagggttgttttgagaactaaggggaaaactgtgtgttcaagaatttggcaaactggggacatagtgtgtgtatgccatgtttatgaatactcctaagtaagtcaacttcgtaagggttgggtctctgtggcatacagaaggtgctcatgaatgcctcaaaagtcgtggaaaggaatcttagtgtggggaggggggagagagagagagagagcaaaaaaagaagaaagaattcaaatctcggaaaacccaaatatgcttttgaaattagtaatctacacccagtaaaaatcttaaaatcttgcttttgttcattatgggatacccaagagatttaatctttcactaattgtttaaaaatcttttataaactgaaagcacacccaacattaagagttctgagcattctgaattacttacatttgtaaaattccttttgaaaaatgtaaaccaagcttatttcataatggtttcttcaaatcactttttcctattgtagtgtcctttactgtctatacacgggatcacatgttaatagtaccaactgtcctgagccctttccaaacaccaggctgtatctaaccctttatcataagatgtctcattgacttctcattgcaaccctaagatggtcatttttaccattttacccactttgcagttgaagctggttggagcagttacataactcaagaaaaggggcaatgctcataagtaagaagatgaggactcaatttcagactactagaagtcacaacccatgagttttgttttgttttttcttcaaagagccattcaagactccatttgccaagcctagacatggcttttatggagtgaatttgatctttattaatagctggaggcactgcataaaaggaacttctggccagagcctagtggtagttaatcccagtgacccagcctcattcattcatctgtttgcttctgggactaccacctgaacatttgttttgtcttggcttcttccctgcagcttgatacttcacatgtgtctctgttctgtctctcccagttcatcaaactggtttctgtcatcctcttttccatgtttgacttcttgagcactccacttgtcctccctgatcaacactagcctagtgaggaagagagaggccatgtattctattttcaggttgttttatgaagcagttaggccccactgagctcagaggagtgtgctaaggaagtctatggaaacaatgcacagttgtataattttgttttgaaatgtgttctgataatactttttcaggcatcaaagttgcctaatccctaaaaatatacaggtgtattatataaagaggataagatattatgcagcttaaactcctggaaaagttctcattagttatattttacaaccaagttccaatgcgaagcagcctgtttgtgagtgatgattagcgctgccaatgccccagcagtagcaggaaagaatgtcatgaaatgatccaacttccattagaaaataatgactgtcttggctgagcaacattttttaaattaaataccaacaattcctagtaatcagagagcctattagccatgaaattcgatttcagtatcagagactattcacttaccaaatgggagccaaataattgtgagtggaatttacagtgccgcattggggatagtagtaaatattatggaagtggcactagggtatagcttcagctctggggaaatgtggcattttaaaatttcagtagcaagttagtgtgatgattaacagaatgcagtcattaatttccaaggcatgatattttctctttagtcatttgagaacccaaggtcttacagtgaactcgtcattaattgctacttagcttcactgggcttttccaaatgtccatcagctcccttgagataaaatcaggaatctttgcattagaattagccttaatttatggagggaggtgttcttgatcccaggagtgatctttaggaagactggaaaataagtttatcatttctgccagctcaggtctaagtattctctcttcttttcacatggtctctcctgacgcatcactgcccaggtcacctcttcaatccttcctcattctttgcaatccctgttcagggatatgggaagaaagtattcactatctacttctgccatgaattgtgtcaagtaacccagacacaaatagtggaagtatattattaagcaggcccatgtagattaaatactgctccacagcacaaagttaataagggttaagaaggaggattcatacctaggtctatcctcagaacacttgttctttacattattgcactatggaaataaaagttgataaaattttaggtgaatacattgctctgccattttctaatttcgttttaatacattttgaaggaaacttaagcttggaaattaatgttttccacatgcagcactaaattccaccaccgtctttcaacagtacaaatccaatggaggaactttcagtatttttcaaacatatatatacatccatgcatatgtatacatgtatagtatacacaaatatacccatatgtatacacatgcacacacaaacacagacatatatacatatatatacacttatatacatatatgttatatatacaatatatatgtaatatgtaatctttcataatatctttcttttttatccatgaggactgaactttgcctaactgaaaaatctctctcttggcacccatatatgtgtctctacaaacttgttggcaaactgtatactggcacatgcattctacaagaccaccaggctcaaaagcagaacatttggcggatagaaactgcagtggcaggctttctaaagaataaggcaggagaagaaccccacagagatgcatggagaagataaaacaatttgtctgttgtcacaccctaggaagggtcaagccaggcattcaatccatacttagctggtcccaaagtccatattctgtccactacattaacctgctgctgtcagaaaaagaaaatgacagatttatagttctcctctccctgccccagtatatgtcagcatttttaggtatatttgaacaaaaactgaagttcatgcatgtcaattgttcttctaaaagccttcttagtggaaacatagggaaacatggcctttagacatgcccaaagtgaacacatttgttagaaaactcagtgttatgatgtatcatttagagttaacaggtaaaacattgcatatcagctgattttaggaaggaccaaatgccatgcatatttctgccatgagtgctttttacttgccatagtgggccataagtaattaaactatgtcattcgcatttgaaaataccatgactacaggccttacaaatagtctccttcctaagttctgtggctgttagaatctgggaattgacattgtttctttttttgtaaggagtccttatggctttcagatcccttactggaattcttgccacaagagggatactgagcagtgaaggtttacaagtctcccttgcgcttgtgcatatggattaacttcactcttttaataccttacttctccatcagttctagagcccactgtgagctgaggtgaaggcacattttccctcccaacaggaaagtgaccaatattatatttacttcctggggcaaatggctttctgtcagctttacttgtaaatctgcctcattctactggatctatctctaaacctaattgcttgcatactgcccaaagccacctttgggagctatttgtgaagactttgtctcatttgtaagctacaaagtctccaaaacacatattttccctcataatcagaggttgtttttgctttggtcaggaacaacattcctcaaaatatctgtagggggctaataagtcacaaagtgttcctgagtagaccaggaggtgtatgacaaagatctatgtctttctccctccttctatccttctctctcccttcacccttccttccttctttccttcttttcttcctttttgccatatgaaagaagaatggtctactgatctctctctctctctctctgtctatttcattaaatggcattgcattgcaatcttcccaacaaccaaagtcagagttgaagatcattcagtccaatctccttattttacagttaaaaaacaaaaacacaaaacacaaaactaccccagatgggcgaaatgacttgatcaagtcacatagtattgggcctagggcctgaacccagattctttgagtccaagtacagtttacttttaggtagttagagatataaagtggccactgagatacagtgcaatagaggatttccggctttttccccatccaaaataatctcagtcaaagacagtttgagggaatatactgattttgaacacgaaaccaaaattatagagaacagaatttttttaaaaaaatttgagtatatttaatttattgaaaaatttaaattggatattatttgtttttgttgcttttatttccaatggcgatggcatttggaactgaaatttaaaatgtaggattaggaagtagctttcacatttatctttattttttgcaaatacctatgcatatacatagattttcaactatgttttcataggatttaatggaaattgtcaaaaatgtctcaagatagttatgatttttaaatgttatgtttagaattactgatcaatttatgatcaaaactgcaaacagtaattgtaaatattttgaagttggtgctactgtatttttccccactatttgctactctgattcttaaatttaatggactcatgttgaagacaaagtatttacagttataaacacataatacatttagaattgtcaatggaagcttgactttttctcacaggatggttcattgtggttaagacttcattagcatcagtaatgtgtaggaaacttaacctctcattttcaaatgaaaagtgttcagaatttttcaactattaggctgtttgagttatctgtgctagacatttcttgtgatatttttgtcatttagtttttatctgtttttaatatcaagggaaagtgaatgctaggtcaacgtattttgaataaaattatagacaaaaccttttgagtaataattatgtagtaggatgcaaactgacacataatggcaacattcgcaaaacattttattagagattttttcctaagaggacatgaaattttggcattatttttattctgctatatttgtcattagatatgtagacagtttcatgcctgctcatttaaaatgtatgagaatctgtagcagtgtcactggtccctgggaaataaatgatgtcattaaaataacattaggactttgagcttcttaaacccagaattattatctttaagtgaggacagctgcatggcagaaaatgttgatgagtctcttagtgcttaattcaagtgttgtgtgatggttttcctgtacaaatctacactatattgatagtacctgagagggaagaaaacaaataagcaagttcaagcttatgaactactacatttctccacacttaagtgtgtcttatttcttacctcaatcaaatattagttggctcagaataaaacttttttttaaaaaaagctaaaattatctctttgctttgcttgttcttgtggtactactgtttcaaaaagtcattatttagtgataaatatatttgtgttcagggctgttattttaagttagaagagtagaatatgtagttctttttatcaaataatcccagtccttaacttcttaattttgatcaatttctgtttgggtagtgaatatatttggagtatttttgcacactggagaatcatcctgtcacctccacacatggaataacataggtaggtataacactctggtccatttctgggcagttgctttgctttatattatatatttttgatgatctaatgcttgtaatacagtaagtcctcacttaacatagttaataggatcttggaaactgcaactttaagtcataccacaaaattggttttgacatataacaaaaccagttttaccataagctaattgatataaacaacagttaagttcctgctgcatatttctggtgtacaaaacatcaccaaacttctaaataaataccaaagctcttctaatattaaacattgaagtaaagtgttatctgtatatacatttaagatagactaataaaaacaagtaaggtaattgtttatttcatttttggtgaatgagtgagcgacagtgattgtttgtattggtggtgagtttaatccaggaatgaaggtttgcaaagtgaaaattgtcagggacgcttcctaccaccacacagttaacaattacaaatatggtgagctaaccgagagcttctgtaccacataagtttattgttgagcatgtgtatgattatcatatactttatgaagttttgctttacaataatttgtatttattaattcactttccaactctctcactgtagttcagggttgcaggtggccagatcctatttcaggagctcatggggcaaggcagcacctaaccgtggacaggatacccttccatcatagggcacactcacccacatacccacactcactcaggctggaacaatgtagacatgccaacaaaactaacatgcacatctaagggatgtgagagaaaacaagaatatccagagaaaaaccatgcagacatggagagaacatgccaacaccacatagacagcgaccccagctggaaatcagtgtttttcccccattaacatcataacgaaataattttttttaatttttattttattattattatactttaagttttagggtacatgtgcacaatgtgcaggttagttacatatgtatacatgtgccatgctggtgtgctgcacctattaactcttcatttagcattaggtatatctcctaatgctatccctccctgctctccccaccccacagagtgtgatgttccccttcctgtgtccatgtgttctcattgttcaactcccacctatgagtgagaacatgaagtgtttggttttttgtccttgcgatagtttactgagaatgatgatttccaatttcatccatgtccctacaaaggatatgaactcatcattttttatggctgcataatattccatggtgtacatgtgccacattttcttaatcaagtctatcattgttggacatttgggttggttccaagtctttgctattgtgaatagtgcctcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatatcactgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttctttgtagattctggatattagccctttgtcagatgagtaggttgtgagaattttctcccattttgtaggttgcctgttcactctgttggtagtttcttttgctgtgcagaagctctttagtttaattagatcccatttgtcaattatggcttttgttgccattgcttttggtgttttagacatgaagtccttgcccatgcctatgtcctgaatggtaatgcctaggttttcttctagggtttttatggttttaggtctaatgtttaagtctttattccatcttgaattaatttttgtataaggtgtaaagaagagatccagtttcagctttctacatatggctagccagttttcccagcaccatttattaaatagggaatcctttccccatttcttgtttttgtcaggtttgtcaaagatcagatggttgtagatatgcggtgttatttctaagggctctgttctgttccattgatttatatctctgttttggtaccagtaccatgctgttttggttactgtagtcttgtagtatagtttgaagtcaggtagcgtgatgcctccaggtttgttcttttggcttaggattgacttggcaatgtgggctcttttttggttccatatgaactttaaagtagttttttccaattctgtgaagaaagtcattggtagctttatggggatggcattgaatctataaattaccttgggcagcatggccattttcatgatattgattcttcttacccatgagcatggaatgttcttccatttctttgtatcctcttttatttccttgagcagtggtttgtagttctccttgaagaggtccttcatgtcccttgtaaattggattcctaggtattatattctctttgaagcaattgtgaatgggagttcactcatgatttggctctctatttgtctgttattggtgtgtaagaatgcttgtgatttttgtacattgattttgtatcctgagactttgctgaagttgcttatcagcttaaggagattttgggctgagacgatggggttttctatatatacaatcatgtcatctgcaaacagggacaatttgacgtcctcttttcctaattgaataccctttatttccttcttctgcctaatttccctggccagaacttccaacactatgttgaataggagtggtgagggagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtctttggttctgtttatatgctggattacatttatcgatttgtgtatattgaaccagccttgcatcccagggatgaagcccacttgatcatagtggataagctttttgatgtgctgctggattcggtttgtcagtattttactgaggatttttgcatcaatgttcatcaaggatattggtctaaaattctctttcttggttgtgtctctgccaggctttggtatcaggatgatgctggcctcataaaatgagttagggaggattccctctttttctattgattggaatagtttcagaaggaatgttaccagttcctccttgtacctctggtagaattcggctgtgaatccatctggtcctggactccttttggttggtaagctattgattattgccacaatttcagagaacgccacaaagatactcctcgagaagagcaactccaagacacatgattgtcagattcaccaaagttgaaatgaaggagaaaatgttaagggcagccagagagaaaggtcgggttacccacaaagggaagcccatcagactaacagcggatctctaggcagaacctctacaagccagaagagagtgggggacaatattcaacattcttaaaggaaagaattttcaacccagaatttcatatccagccaaactaagcttcataagcgaaggagaaataaaatactttacagacaagcaaatgttgagagattttgtcaccaccaggcctgccctaaaagagctcctgaaggaagcactaatcatggaaaggaacaaccagtaccagctgccgcaaaatcatgccaaaatgtaaagaccatcgagactaggaagaaactgcatcaactaatgagcaaaacaaccagctaacatcataatgacaggttcaaattcacacataacaatattaactttaaatgtaaatggactaaatgctccaattaaaagacacagactggcaaattggatagagtcaatacccatcagtgtgctatattcaggaaacccatctcacatgcagagacgcacataggctcaaaataaaaggatggaggaagatctaccaagcaaatggaaaacaaaaaaaggcaggggttgcaatcctcatctctgataaaacagagtttaaaccaacaaagatcaaaagagacaaagaaggccattacataatggtaaagggatcaattaaacaagaagagctaactatcctgaatatatatgcacccaatacaggagcacccagtttcataaagcaagtcctgagtgacctacaaagagacttagactcccacacaataataatgggagactttaacaccccactgtcaacattagacagatcaacgagacagaaagttaacaaggatacccaggaattgagctcagctctgcaccaagaggacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactgtctctcagaccacagtgcaatcaaactagaactcaggattaagagactcactcaaaaccgcacaactacgtggaaactgaacaacctgctcctgaatgactactgggtacataacgaaatgaaggcagaaataaagatgttctttgaaaccaacgagaacgaagacacaacataccagaatctctgggacacattcaaagcagtgtgtagagggaaatttatagcactaaatgcccacaagagaaagcaggaaagatccaaaactgacaccctaacatcacaattaaaataattagaaaagcaagagcgaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccagcgatcccacagaaatacaaactaccaacagagaatactacaaacaactacacaaataaactagaaaatctagaagaaatggataaattcctcgacacatacaccctcccaggactaaaccaggaagaagttgaatctctgaatagaccactataacaaaataatgttattcaaagttcatctgacatgctttttcatttattcttcgtacggtataggaagaataagtatatgctttttatgatatacttaggtcttttctcaggttaggaaactcttcttcaagtaaggctttgataattgtttcactgcaaagattgctgccttattttttagatttggatgtctgttgtctgcattcaacatcaatcataagaggacccttcatcattttcaccttgtgtgttttagatagctcaagtagtttctatataacactcctcatatattgctttggatacattctgtttcttaatgtttccaatgggtgttattttttctgctgttgcagttagagcttccttaaatcctacttctttacatttaaaaaacaattataagggggctgccaagtaactttccaaaattttctcttagctcctattgaaagctattttcaaagataactgttccccaagactttatgttgtttctgctttttcttttctttccagagtttttggatttttatgtgagatttttgtgtacatttagattgcagtgagaaaagcccattccaaaccccatgtttttcaaaagagagggtctatggagaacccttgggcactctctgcatccaattggatgctggtcaaatttctgtctcatatcaatagctgcaatagatggatatgagtagcccagagctcagtttaaaagcaccaagctgacattcatctcgtgtgaccctgctggtttgagatgaacccataaaatccataaaattaaaaatctcaataatcatagcccctaggaatctaagaattgtttatttcctgttgtgcctatagtgttgaatttgcaggaatgacttattgtagaacagaatatgtttcattttctgtaccatcccctattatccaccccacacactcaccagcaacatatggtcttcctttccagtgttttctctgaaacttcagttctgaacagatatgctaagatggataagcagtgatggggctgaaggagagcgatgctttaactgcactttgtgttcaaggagtggaatattcagacatgttagactgagtattaaatgttcaccaagtcacttcaacctcatccttcatttttaattttcttcatacattactgtcagaaattattctgtttaattatagattggtgcaaaagtaattgaggtttttgccatcaccttcaatggcaaaacctgcaattacttttgcacccaagtaatattttattataaaccacagcacatagtgcattctcaacaaatgttgctgttgggatgcaggaatggatggatgaatagatgaatgggtggctggctggctgaatggattggtggatggatgggtagttgttcaggattctcattggtatgggatttgtgctgttagtctgtgtgtcctgcagactaacggcacaaagaaagatagaaggtcttgctacctgctctcagactggtataactcacattatttggcaatacagagactctcagtcttagtttttattgggagtgtaaattttgcctctttgctatgccttcgtagacattttggtggaaagtggtgacagacagtgtcacaggctgccaaccaggtaccactttaaccaccaagactctgataatgtctcgtttcctcctcccatctctaccccttgcttcctctcagactcctcctactctctgtctctccagccatgcctccacttgcagaatatccttctctctacccaccgttcatctttaccctggtcatttctttagccacgtcctcatgcgtatccagcatttctatcctgctgtgtcaaatataagacacattctttaactttagagggaatttatattttctcgtctgtagttttctggaaatagtggggaggttgtaggctgtgatcaatttgggagccatttaatggcagtaaaatgggcaaagcaatatatcgagaattcttcaaattgatatttatctattttcatccagccttaggtattttaatacagatacaacttttactaccagcaaactatagttagtaattgattttttgcttcctatttcaaaagctacagataaaaggacattaatttttaagaggccactcaatcagaaaatgcattcttcacttagagtggtcaaaagagcagtggagtggaactcaggaaaccagaggactagctctgactctgccacttacattgtttgaagcaaggtatttctgttagggacctccatgggccttcactctaaccaacttttctgtcaccttcatgtactaagagtctctgatcccgtgaggatgacgtctacttgcccatcactgctcctacctgaaacccaaatgtgccgaagtttggatcccagcacaggctcagcatcatcatggatgatcagctcatagtcctagaactggctgtggagacttttctgaatatgaacattgtttttaaatcagtgttagtaaacatggactcaatatttacttgaaaagaattatttcagttacagattgatgtagttcattttaaccaccttgtgtatgaaggatgaaaaatgagtgatctagttttgaagtaactacaaaaattgtgtttgtatcaactgtcctgtttatttttgcttgtcataatgagaggacatcattattaaatctaaattatctccaccacagtgtcactaaatatgatcagtcaactatctctgcttcctttacttgagatctgttgaactaaggtcaaactgagctcaagcttctcatccagattatggcaatacacacctttccccaccaattgttctttaaagcattgtgagttggcttagcaatgtcttcttccatctaaaggtgggtcacagcactggcaaatgtataatgttggactattgctgggagccacataccgcattagatttttttttttttttggtacgctaacagctcctcattttctggcaatgtatgacaggcagaactgtaatagttatcctcataagcaatgtgcaagttagataattgcaatactaaacacaatgaatattcagtttgtttaggggcactgcagtgaaaaaaagaaatgcatgtagttgtgatctacctgtctcaccaaaactcacatttagtctttcctaaaaatacctgaacttcattaacatcaacttcaccagtactctttcagatgactgcatattgaattaggctgaagggaaggggaacagtagcccatggggtcatatcagacttgtaattctgctctttccaaaagacttacagtgacagccaaccacattccaagaactgcactggtcaccagagatgcaggaggaatgggccatcatttctgtgcccaaggagctcacacagactgtaattacctctgggaatctcaaagaccaaagcaatgtgaaattttgtccacattgttctcaatagtgactgagctattctatatttgttccctgatctgttttaagaatgaaaatatagagaaattagagttcaggtgagaagagttaaagtgattaagaggatggtgaactcttctaacaagaaactaatagcgtgtagcttagttcaacagtggtaagtggagctcatgataatgatatataaatgtttgaaaaatataaacaagaaggggcaacattgtttagtattattcaattacaagtgattaatagcaatgcaaagtaattatgaaagggaaattaaaaatggacataaggaaaaaaagttttcttttggtcttgtttcctaaaagaaaatatagggctacattataggaaagcatttgcaactacacaagaaaatatgaaacaagcaagctaagagcaagtaatttaccaatggtagactaattattttattaattcattattaataaaatttattaattcatttatcaaatgtttttattcattcatttatcaaattaattattcatcaaatgttttaggttactcacctatttaacattttctttgctcccatgtattcatgtatttcatttgattatttttttttttaacatttcagtgttccaaaaattgggagacataggcagtaatatattttttaggaaaatactggtggttgtaataaataatctgatatttcagtagtccaacacattaaaagtttggttctcattcatataaagtccaaatcaagtgtttattaaaggcagaaggatgagggttggattgtgggagtcgatggttggaggggcccagatccatgtaatcattcagagatccgggctgaggaagatccataaattcactgtgatctccacagccagctggaagataagagcagaaagagactgaggaagaagtaactcctccttacacactcggttccagaagacactcagatcagtttcacctatattccattgttgagaattcatggaatgacattgcttggatgcactgggcattgggaaatgtggcttctttcctagcatcatctctacaactttcaggagagcatgagtttttaatggacaaacaggtgaataaaacacactcaaattcctggcctcttggaaaatacattttagttggaggaaactgatagtaatactataaaatcataagtgaaataaacattttttttgtaaggacataaacattgtgatggtatgtaaagcctggaagaagtgcagggagtgttgggtgtgcaattttaaatggatagtttggaaggagctcagtggaaaagaggtatttgagcaattatttgaatgaggtgagaatgtaaatcatgtggaatgtaacgggaaattatttaaagctgcagcgcagcaaatggaaagctcatggggtggaatcatgtctgatatctttagggaacagctggtggctaacctattaggagcaaagtaagcaaaggttagagaatggtaggatatgaggtcggagaagtaatagggttctaaacatacagaggccttaagagtgacagtgagaattttggctcttactctgaggtacaggggaagtcattagagggtattgtacagaggagtgaagtgatttgatttatgttttaaaaggattactctagttgttgttctgaaaatagactgtggtgcagtaaggcagaaggagggagaccattagaaagctttttcaataattgaggtgagaaatgatgacagcttagaccagagatattgagaagtggctggattctgggtatattttgaaggtggaagtgacaggatttgctcatggcttagtggtaaggtgtgatggaggaaaggagtcaaggatgactcgaagactttgtgcataaaagactaagtggaagagtaggatttttattaattgagatggggaggactgtacaggattctcatttagatgtgggtggagcacataagggtcttgatttggaatgacttttagatatttaagttgagctgacaagtaggcagttagatatatgaatatggtattggcatggggaatggaggaatagatccaaatattgagctccaagggactccaatatttagaggctggagaagtggggaggaaccagcaaaggggaatgaaaacgagtgacaagagaaagaaaatcagaaaagtctagtattgagaaagccaaggaagagaagtgtttgaattaagaaagaatgaggctgagccaggaggatctcttgagcccacgagttagagaccagcctaggaaatacagtgacaccccagatctataaaaaaaaatagccaggtgtggtggtgtgtgcctgtagtcccagctactaaggaggctgaggcaggaggattgcttgaacatgtgaaatataacgggaagttcaaggttacagtgagctagatcataccagcacactctagcctgggtgacagcacaagactctgtctctcttaaaacaaatcaaagaaagaaagaaaggaaagaagggaaaagaagaaagaaaagaaaggaaaagaacagaaaagaaaagcaaaaaggaaggaaaaaagagccacagtctcagctgctgctgacaggtcaaataaaatgaaatagagaggtcattggtgatcttgatgaaaaaagaaaaaagaagccgagcgcggtggctcactcctgtaatcccagcactttgggaggccgaggcgagcagatcgaggtcaggagatcgagacaatcctggctaacacagtgaaaacccatctctactaaaaatacaaaaaaaatagccaggcatggtgacaggcgcctgtaatctcagctactcgggaggctgaggcaggagaatggcctgaacccagaaggcagagtttgcagtgaaccaagattgcaccactgccctccagcctgggcgacagagtgagactccgtctcaaaaaaaaaaaaaaaagaacaacaacaaaaaacagttttagtgtagtgatgagcaaaaactgactggagtgaggtaaagagaaaatggaaaaaggcaaattggtggtaattatttaatttttttatctaattgttttgaggattttttctataaaaggagcaaagagcaaagtgatagggtgataattagaataggaagtagacacaaggaagggatttcaaaatgggaaaaatgacagcacatttgtaaagcgatgaaaaatttacaatgcaagaaagagaaggggagttaatatgcaacaatcttatgtcgatgagaagggctggaacaggcactctagtgaagggactggagataaaggcaggtttatctgtaatggttcagattaaggagtgaaatgcatggtaggcttgtgtgagttccctttgaatttctccttttgttcttaggaaataagaagcacaggtcattcagaggagaagatgtgaaatcattctttaagggaataggatagtgaatggaaaacggaaatcttcccaggcagtttcgaagaccacttgaggctaatggtcatgtgtggaaagcaaaatcattcaaccttgtgccttttaaaaaattttgtcccatcatagtacctgtgtgggagtgtgactatagcataatggagaattttgtttagcgagttagacattttttcttggtcagtacaatggcatgagagatggttaaggagtttaatacttgagcaagagaattattaaaacagcatgctggagattctaagcttggtcaggtgggtgtgatgactttaaagagttgaatatggtagtaaaatggtgaaaggattagtgtatttgaaaaaaaaaattagtgttatgctactgaaaggaatgccataggctcactctgataggaatctttgaagctaaaaggatggagtggttagttgttggtaatgagaagatttagatacaattatagaagtgaggggctaaagatgattgcagaataaagccacaggaaatcaaagaatggagaggctgaagtattggaaggatcgtcaaacttgtttaaatctgagaattttgacaggaacagtgtagatgtgacacagagccaggaactacagtcttacagctatgacattccatctgggatttttcaagtatctcattgaaattttcttttttaacagtctagttggggttagctctgagtttttgtttaaatagaaatgtttttattttgactgtagctttcaaagatgcttttctggctagaattccaggttaacaattatgttctcttagcattttcgaaatattgttccattgctttctgacttttgtgtttgctattgagaagccagtagtctaattattgtttattgtggatgactttttttcccacagctgttttttaaaacttctatttatttttacactgcaatttcagtaggatttatctacgtgtagaattcacaaccttctgattctgatcattgttatctctcattaattctggaaaattcccatgaatttttactccaaataatcattgtctttattttctattaggattttgcactttatactgcttgttggatctttccactctattatcctttccttaaaatatttctttcctattttccatcaccccttatatgtgtacttcatttcttgtattttcttcagatattttttcaatgtactaattttcctttaagccatatctgatagtctttttaacgttacatttttcatttctatagagttatttggttctttatcaaatacgtatgtataattttgttagttcttttttcctaactcctactccaatttctgttatttatttaaacatgttacacatgcatgatttatagtctctgtgtcataagtccaatatctgttgttctttggtgtttaattctgtggtatgttggttctgcctacacgtatacatggcagcttatttcctcatttgtataataattttttaaattcttttgatctttgatcctttgaaattgttggggtaatttttaggctacatttaaattgtcttcagaaaggatttctaggctactttcagataactagaggccttagcaatctataactactttaaattatactttaagtttgggtggggagtggacaagggtatgataaattttgtttcaaacatgagggcaaatttttgtttaagaattatcaagagagttctccttctccttcactgcctcctcttcgtccttcttcgtatctactttaggccaaagctaggaccttcattctaaatgagttaccatgtatcagggattcaagatactcacagggagtcttcaatctggccttctaccttagttccttatttgcatggccgactaaaactcagactccgggccaccagtgattggcatataaactgaagaaaacttcccattctagtgcttgcttactcatgtggattctctctttctttcctttcttttttttttttttctttgtaaagccttctaaagaattcccttactctcctgtgactacagtcgtgcattaaaaaccgattatttgatatgttatattattaattgtgctaaatgggaaataaggggtgtcatgttctggtaacatttactcaaacttttatatatacaagtctcattgggtgcttcatctttgtgttttctcttttttccagggctctatgtatattaaggatagcaattctaggccatacatagcaagttatttttttccctagtttgttatatctagttttaactttgataaaagtgctgtgtttttcttcttaagaccttttaagtttttatatagtcaaatatattgatctttccttttaagttctctgcatttgattccatgcttagaaaattgtctccgtcgataccataaaattattttttaatctgatatttcttctagttcttcctagaattaatattttcaacgacccgtttcatctgtagaatataaatgactccttttatgtggtgcagaatgcttttatgtataggtatgccttcaactttctattatattctatctatataatatatatttataaatatactttttctagaaaaaattagcttaatttaggtcatattgagtagttccatcacaagtttttttattttgatttttttcccttctccttcctttagtcatctcacaagtttttggtgttttttcctaaggaaacatggaaggtcattctactttgcctcaggccttgagaacaaaaatgaaaaagttggacacatcaaaaccctaaatctaggcactacagacaactgaagaggcagttcttatttagggtgatatattctttaatagaagatactctgcttgccatgggaacgtatataggaggtgcgtctgacctggacaatacaatcaggaaaagcttcctggcaggggtgatttgaagtctgtatttccagtatgtggggaatggtggagaaggagcaagaaagtcatgccgaggcaacatgtgggacgtttccagtgagacaaagcagaattatttgaaaaactaaaacagtagttcagttggggagaggtatacattgtgatgtgcaaatgctgcagaatgaagccggacaggaacaagggccaagcaatgaattgtggatgttttattgagagcaatgagatgcattgaaaggtttgaaactgtggaataatgtgatcaaatctgtattttttgaacaacatctaggctgtagcactttttatactggatagaaaatgacaaaacccttagagggatgggctgatttagaggatattgctgtaatgtaggtggaaagtaactatggcctagtaaatgtggaaggacacagatacactcagtagatatttcagggtgaatggccagattaggtaatgactaagatagcaaggatgggagaaaaagaagaatcaaggaggtgactaagcttttttcttgagcaactggtagattgagttaacattttctgaaaaacgtgatagaaggaggagctgtttctaggagggaaataaataatttggcaggagactttttgaactagatatctattgaataacaaagtgacaatgttccccatcctctcatttccattcccaattttacttctcgtcccaattcaaatcattcttacttatgatcggcgctatgtcagtgcctctcagctggtcttcccagacccagtacacctaatcaatccatcctacaccaggatggattcttcgctttccatacttgtggctttgtttattctgtcccctcccctgggagacccttctgcctacatatcttaaagcctatctacaaggacaccttcatgtcctaggtaccaccagtggcttctgatatgttcccttgatgatcagccataacattgtatttgaatatgttgtaacttagtatagaaatcatgggtactggacacaggcaaaaccacctctgccacttgcacggccctggaccccaaggaaatcaactgctctaaacttctgtttcctcctttaaaaatgggtgtaataataaagaccttgtttgttgtgaaggatacaattaagattggcacaatatctgactcccccacacaggaatttcatttcataaatggtaattattactcatattgtctacaaagccatttctcacagtctgttgctatagtagtcacttacgtgtctgtatctccttatatgaaggcatgagcatttcctttattgtcttcacaacaattaataaggacaagcacaatgtaggtacacaatatatggcatgcatgaatgtttaaataatgagagttactaggaggatagagaattacagaaaaaagacttgcttaaactgaaatatttcttactgtgtgccataaagtgctgaggggtgctgtcttctaccatgaatccttccagcctgaactgcaatgattttaaattttttgacagttctgttctccctaagagtagtaattttggtggttatgcatagatcaaagatgcaatagggaacgttttaagtgatgttgtaaataatgatttcaagaatgtgctttaatttttattgaatatcatctgattagcaatcttgtttttgttttagccttgtgaatatttattctagcataaatgagtacagtaatttctaatgcaaatattgtccacctgggtttcctgatgtctgtatggataattcaccttgttctttgttagtggaattattggtgcctctcaggttggaagatgcctgtactgacctacctgtggccagtagaaggtgggaagacctgcatattgcctctactcaacctctttctcccagtaactaagaagcctggactgggctggttggtgcggttcgctctttctgactctggttgtctcattcatgccagttcgggtgacacttgtgagaggaaggagttcagtctttgaggtcaggcctgtctggctcccaggcccaccactgccacttcctatgtttgcaatctggaaatagctccatatgttttttgaacccaagttgtattgttttggtttggtttcagtgtatgtaggtatgtgataatctttggtggcttacgtctgtaatgccagcactttgggaggcagaggcgggtggatcacgaggtcaggagttcaagaccagcctagccaatatggtgaaaccctgtctctactaaaagtacaaaaattagccgggcgtggtggcgggtgcctgtaatcccaactacttgggaggctgaggcagaagaatcccttcagctcaggaggcggaggttgcggtgagccaagactgcgccactgctctccagcctgggcaacagagcaagattttccctctcaaacaaaacaaaacaaaacagaaaaacaataattttaaaacaggtagggtgacccccatttactccttggagatctagttgaatttatattgttcttccaattctcaggtctgcagaatttaaaactctccccaaggtttttacagagtttccaccttggatgttctcctggtcccctctacctccagctcccgtgctgtggtcattgctgcccttcaacccatatccgtcataataagaaacttgggctttctaccagtttccttttaaaaatccacttgcatgtgtttgtagagtgagctcagtgaatgctggggtatcatgatggagtcacactgcctttaggtctttacttggatttctgttttccccctcttctcccatttctggattaagccttctctccataactgctctcttccctccttcaccttttttctgtctgtctccctcctttccttctgttctcttctttctgtcagtgtccctttctctctctctctctctctcacacacacaaacacacacacacacacacatacatctcttaaaaggatagtgatactttaccagttgatttacaaaaatttaaaagcaattatatatagaaattagtcagtgagctgcatggtgcaaatctatattggtctttccttttctttgcttttgatgaccaaagaatagctatccaaagatagctttgggttgcagctgctgccaggtatcatgcagtctggacattgggcacaatgtgtcagcagaactgggggtgatccaagcagcccgggaaacaaagccctgcttgtatctctagagtgttctttcccctgaagaggcccaaggtccctgagagctcagcatagctcatttctttattatctgccacagtcttcagtctcctctggatgccagaggggagcagattggatttctgggagagtcaacaaatagaagttctaagaattaaggcaggccgggcatggtggctcacacctgtaatcccagcagtttgggaggccaaggcaggtggatcacctgaggttaggagtttgagagcagcctggccaacatggtgaaaccccatctctactaaaaatacaaaaattagctgtgcatggtggtgtgcgcctgtagtcccagctactcaggaggctgaggcaggagaattgctctaacctggaaggcagaggttgcagtgagccaaggtcacgctactgcagtccagcctaggggcagagcaagactccatctcaaaaaaaaaagaaaaagaaaaaaaataagaattaagggaaagctggctcccaggcaatgggatggagcagaatataggggcatgagatggagaggctatgctgtctttctcccttttgatgatgctactggggaaaagtatcatcatcaaaatgtggaagggaaaccaaaaatgaagggaaggtactgaagagaaacaaaaatgtgctgaatccactcttaggaaaatgactggtctttttccttgctgtgtattcagagcatacctactgctagagctactgaatctgtgcttctggagtggtttggccatttgcagctccctcatttgaggactaatattgccattctgctgttctaagcagccattatctgccgcccaccccaccaacttgataccccattagtgttagggtacataacagtacctcagccaaggacttgagtacctccaggcaagtcactcactcaacattgtggtgtcttcttcagtgatagaatggaatacctgggcaatcccaggagtcccctccacctcaaacaattcagttcttctgtggttctacacttatgattcttttgatgagagtattcatggctgttttctcatttttatgtcactaactatcactggaaatgcattttaggtttatcatcattttacagtctcaagtttctgtttttttttctttattttataccaagacgcaaatgtgaaaaaaaaaaggaaatagaagtattacaaatatcttagcttataatagcagaccaaaagtaattggaagaaacatgagatgagaaagtataaacatatttttaacataactctgctgttctactgataaacaatttctgctgctctatttgtatagagacaatcaatatattttttagaggcaggaaaagatctttttttttttgtcagatgaaatgttgctttctaaggatagtcaatcggtgcccttaataaacccatcagcccttgtgtcttggtatagcattattggtagaggtaattatagaagctaatatttggtaactaaagaaagaaaactaaagaaactaaagaaagaaactaagctaaagaaaggaactaaagaactaaagaaaggaactaaatagctgaagaaagaactaaagaactaaagaaagaaagtaaactgggaactaaagaaagaaaaatgatgtattcaaagggagagcaagtccctcccaccatcgtttgatctatcaggtgtgatttgcctgctggcttacatcatggaaattttacttccattttttaacaacatagctgggagaacaaagaatctcaaaaacgttttagttgtagagagggtttactgccctgatgaatgactgatctgtatttctgaaaggaatcttctgcctcttatcatgatccagtcttgtattttttctcatggtgacagtgatgttgtacctcatgtcaacatgaaacataatttttcccaaacaaacttttaaagatagggaaacaacattgacatgttctggtttggaattgtatcagtgaattaaggaatggatttaaggaaagatcattagaccaagagtcaaaataactctgtggtccaatcctgcatagcttatagtcctgagatcacaggaaattcacctaagacaggatcattctagtaccatggagatttgcctggtccacctcacagggctctcatggagatccatttaagtgaaatatactaactaaaggtaatcattttcttatgaaatatcaaatatatataaaaataatatatttattataaaacaataaaaatcccattcactaatcattattgaatacacattttaaataatcatttgctgaacaaatataaagaaagcatgaagcctaggagatggtggaaaaatgacttatacgcgttgaaaaaaaaagcatcaagatgtcaatagatttgagtagctaactaaattagatataatctttgatggataaatgtaaagctatagacggacgatcaaggagtaatgcatgaagatgagatggcctgatgcacacttatgagcatttaagtacaagagaaatctgagccaagagaatgccccaaaagttcctgaagttctggtaagtgctgatggaaggggtgacccacagcctccacctggagtttagacatcccctttagctgaacattgtcctctcctgaaagtttgctgaatagtgaatttggagatagcaagaacctttatctctgtatttttaatggaagaagaattattcaaaactccaaccaaagtcctcagtatgttgaagatactcttaaatacccatataacaactattcatgcacacataaagaatttcatacatccattgccctgttatttaacacttaaacttgttctttgaaatatttgtgtgcagaagctgagcagtatcagagacaaattaaattttcatttcataacaaacatctatctcaatatactttatcattccaacttttcttctaaaataatggattttcaaggcctttaaaactcactgactttcttcaaaggctttttgacttccgtaggagacatatttacgtaaaactatgaggggaattgagagtgataatgaaaaatccatctattaatagcaagcacaagcaggagatgcttgttattagaataaaaacacatagacaattgcagaacactctgcttcctctcaccaggtctggcctgcaattagacattttcactgatgtgtataaatagagtggggtttagagtttgataataacttttaggtaaaatttattgtatatcattgtagcaaacattcgtagaatgagagtacatatagtgaaagatatatacattgtgtcagtttgtgtcactgggaaggattcactatctgccttcttaatgtgacacagtaattcaattaattgtgtaggactccagtccctggcacatagtacatgttaaaaaaaaatttgctgaattactgacagaagggggaagaatatagactactgcattggggttatcagtagagagtacataaagaaaaatgtttttaataattaaaaattctagttagaaaataaaaaaggagatagtgtgttctgtgtctctagatggacccttgcaggaggaggaatattttaggaatttcgctgaacagattcatccctagttggatttttagatgcaataaccagaaaagatcctcccaccaatccaaagtctctgattatctgttcaagaatttgtatatcccaactctttgtgtagttaaaaattataaatcaaattgctctttaatctagtttttatgtcaggaacaaaactcacatttcaatttagaaattttgcaaaggcctgttttccattgctatcatcatttttattattgtcttaacctttacttttaaaaatctatcattttaacattataatcattagaagaaatgaacgtgaactaaaatgtatgtattttgtttcatttttaatttaaccatgtcttttacaagttaatgaggatattaatttttcaaatataatttttagtttctttattttgcctaaaatctaaaaataactaccatataaaacaaatattatcttgttcactcatcttgggaatattcttagtacaagaatgtgtttatgatttaattgatgaagaatgtaaatatacatctacacatattcatatgtattaattttcatgtattatatatgcataaattaccttttcaatgtacatatgtgcatatattttgtgtaaatgtacactctgtctatcagtaaatttgtagacatgcctatgggatttgcaatctagttaagttatttcttactgttacgtacttttctgttttacttatggttaactgatgcagggaaggcagaggcaagggaccctcattttggtatcctatttgggggcctctgcaatatgtgctttctggagcctggaccatgcatactaagctttgtggactatcagaggtcctacaagcacacaatatttaaaattctataagatccatgtctgctgagtacttacctgagtgattcacttcacgaagacctgaaggaagtcaatgcaacatttatgtttccattctctctacaccagtgagtataatgttcttaggaccagtaaacattgggatcagccatatgttgggaagacaccagctagttcaccacccatggtacttagacctattcttttttttttgagtcatgattaatgaatcctatcatactggctgtcagaattctttggattcaatttgtagatacccttgtccatagactcattaagacaattttcatattagtgtgaatcaacatatataagtaacttgagtaactcctcccaagaatgcccttctacttttagctattagatcctaaatatacaaaagttaagaggctttatagaatacaactgcaaattttatttcttactatattctgttgaatttttctcagtttgattttttttaaaaaatggcaaatataacaaaccccaaaacagtggagcacttctatttcattgtcaaacccaattgacaaaaatttgaagttagtggaatttttttgaaggaaaatttatccttgaagtcatcaactattgtaattcatgctttagaaaaacaagcattaggactgaattgtattttcttttaaattcatttatgttaattattgtaaagaaattttcccactctacttttgttccccatttgctgtttgttgttgtcgtggtttgtttgcttgctttggagacagagccttgctctatcccccaggcgcaatcttgcccactgcaaccttctctccccggttcaagccattctcctgcctcagcctcccaagtagctgagattacaggttcctgccaccatgtctggctaatttttatatttttagtagagacgggttttcgccatgttggccaggctggtctcaaactgctgacctcaggtgatccgcctgccttggcctcccaaagtgttgggattataggtgtgagccaccacacctggcctgtctgtttgcactcctgctgacagcaccagtggattgctattgtgtttttcagagaggaaccaccaaatcagaactgttagacctcaaacagttgtttttgacacagagtggtggaagggagccactcaagaaaccttgctttattatcttaatgctctcaaagcaatctttgtcatttcctttgaatagcactttgcgagtttcacttgacatatggcatggccctcagggatataggcatttgcttttcagtctaaacaaaaatcaagtttataatttttatttttgtaacaatttatgtcagtattcatcacagaaaagcatattcctctttttccttctgacttacattcctcctcaagctacctgtaagtaatgatcttgaacagtacacaactgacaagtgtttcctgcgtcgaagaatggttgagtgtgtgagtgtagaacaatagaattatagtttataaatactgggatttcaggactaatgtaataaggagaaaccatccttcctttttatagctttgagggaattgcaggaacaactactgcagcttacagtagaacataactgtttagaatgccttttaacaattagtatttagtgtctcactttatttctaaggccactgcacgtgatacagaagcctgatgacagtagcatccacattcttttaaaaatgtgtaaaataaggttataaatgtttacttttacaaaaattcattgattccctcctttattcaataaaatgtatcaagcacatactacatgataggctctgtattaggtacccatgtgcaaaatagacgtttcctgcccttgagaagcgtacagcttagttgagaaatttactagtcacataaaaccacaaataaatgtataaggtaagctgtgatactgctattatgaagaggcacaggatgctgtaagaacacataaataggggtttcaatgaaggcttgcttaaggtgttaatattagaattgagctgtaaaggatgaaaatgaattgcttagatgaaagaggtgacaccagagggagcgggcagggaaagggggagagtgttccaggaatgcagagagacagtgggaagaaatgaggtcatttaagtggccaagccaggtcaagctgggcttgttagtcactaacatattttgttttttatcctcagactataaagtatggaatgaaataatcgtatttgtgtacttaaaaatcactctggatgctatgaaaatataatgacattgagtactgctttcaataagtcacagtggaatcttgcaaatatttaaaataagtcaaccaccaaaacaagaattgtatttgagttaacagcatgtccacagaagggtttaattggattagagctttgaaaactgtaagtagaaacacaaattgcttcagagaatttataatcctggaatgatatttcccatgcccagagagaaacccattcctcttgttactgtcttcagaaccacagagcatgtcattaaatagcagcttagatggctgtgcaggcctactagggtgcagatggattggataggggtcaggttgcattggagtttcttagaagcttcacttcacctaacgttggcaaaacagctggacctcagagaactgcatgcacgaggtaccagatacacgaaaagaggcaaagcgtgacacagtgaaataacaggtactgatgttgagacttgtgaggtggcgcctggtttctagaccaggaagttttcttactcatctcttcttacaatgggtgaggcaccgggcacacatgagcgtatttaactttccaacagccatgtgaggtatagagtgtcagctcctttttaataagtgagaaaaatgaggtttagagaatttaaatactaatacccaaagtcatacggggcatgaggacaagattcagactcatgtctgccagctccaaaccaggatttatctgagcttatgtcactcatttaaaattggtatttgaattcgtatttatttttgaaggtgttcatacaaagaaaacaaaaagaaacggagtctggattgtagaaaacatataaaacctatatcaaaaatcatctaatagtgatagatagagaagtttcatattgaaataagcttttagaaaactgctctggtaaattaattggtacaaactaagaataaaaatgggatggttagcatagcttgtttgtcacaagaaacagaaacttcacctgcctttttccctgtgaagtgttggtgcagtgacaggattcgcctctcttattaatagtctgtcaaaatccaggaaaatcatgtgatgcttcagagatttttctactgagtgaatatatttgattaaacaccatctgcaaaaatcctcatcacccaagaaaataacagatcgtagatctaacacatgctttacatgtgtcaagaaatatgttggtcaaatcaagagataagcacataggtttatctgaagtccaacttaaaacagctgctttcaaattccttgctaagccaggaagcttgactgatgggacccagagtgatctccctgtctcccctcctagctgtttcttctcacctctgaagttactttttccacattgagggggcctttcatgagtaccagggagaatgagtcaattgagttcatgcaaaaaaagaatcccatcctttcaagaaaggagggagaaaagaggagggaaagaagatatttaaggggttttgctattttatctggcttaagttaaacttgtaatgtcaaaaaataaagtctgaggaaaatatgagtaaattttatctttccttgaggtggatcctttttagtcattggagcaaagtcaaaaactgtaacagaaaatattgataaatttaatataaaaatgttaaatgttattgtgtcagatgaagataaatacaattaaatttaagtgacaaactggaaaaataataatgacattaattacagaataagtatattaggtaaataaaagctcatagtttagtaagaaaaagataaatgataggaaaaaaacgaacaaaggatatgactaggcaggtcacaaaagaagaaataaaaactaccaagaaacatttaaaaacatttcaatcttgttggtgttcaaagccacacagatgaaaacaatatttttgcctatcaaattaatatatttttacaatgtaacccccattgtttatgtaatgaaaaaggcacaactttccttattggcaagttggcaatatgtcacaagtcagtataatgtctaaacttatccagtaatttacctttgtaaaattgttcaaaagaatacttggacatgtatgcagttatttgtgctacataattatttataatggtgaaatatctttaataaatgtaatgtccaccaatagaggattggctacttaatttatgtactctgccccgatagtaccctgtaaactcagtttttaagtctccacaaatttatgttaatttttatcattcattgattcaataactaaatatccattaagtgcctactgagtgtgttgggtacccatgaagacacaggtgatccagcagtgggcaaacagaggaaaattcttgtcatactagagaaccaaatgattcaatgacaatgagtaaagcatgttttgcatcagatggtgaggagtgccattgagaaatgctgagcaaggatggggataatgctagagttaggtggaggaagggacagtgtgattttaaatagggtgttagggaaggcttagtgataaagtgacaagtgattcaaaactcgcctgatatgaggaacagaaacctgctgatatcagagagaagggcatcccaggcagaggaagggcgcaatggaagccttgaggggagagcatgctggatgtgtttgaataacagcagaagggacactgttgctgagcaaagagaaccaatggcagaatagcaggagaagaggttgcagagaatgaagagaaccccataggccattgtgaggatgcgggctttttactcagaaagggatgggaagctgttggagggcttggttgatgaagtgacattattttacttacatttcaacatcatcactctggacactgtgtcaagaattggctgaagggacgctgtggagccaaggagaccatttaagaagctattgtaataatgaaggaaaaagatgttgggaatgtgagctgttgtagtaagggtggagatagtagggaagggtttggttgatatacttgaaaattttatattgtttgaatgtcttaattttatttttaataagcaatatgtttacatgattcaaaagtcaaaattattttaaaagtgcatacacacagtccagtccttctgaatcccattttattaattacctatttgttcttccaatggttctttatatgtatatgtctactcctgtagggtgtgtgtatgtgtgtgtgaataaaggaaggcatcaaatggattatgctagcttttgtctccctttcttacccaaacatgtttgcatatgatataaaactgcacagtacttacttttctcacctaaaaatgtatgattatattttgaatatagagccaacaggactttctgaaagattgcattaaaggtattaagaaggagaaacatgaagtgtgattttaagtcaccggaagaagcgtgttgcctttgggataattgcttgttcagcatctttcttccctgacttaacgggagagaccatagctagatggttcccatctacttcagtaaccagtaaatgttagaagccgcatatttactgttgaataatgagtgattgataggataaatattgtatacataaactaaaagagaattcaagtagcaggataaaatttgttttcatatatatttaatgttttgagaaagtgcttctaggactttggtgaaataaatatttgctctgcttatagaacgtgctgcagatacacagagagtatgttggtatctatactttaaaaatttgctgaaagtacatacacaagaattttaatagtagttatctcttggggttgggattatagatgactttttttttgcttcattattttatgtcttttctgatttatttattataaacacattttttatatttttattttattattattattttttaagagacagggtcttgctccatggcccaagctggagtgcagtggcacaattatggctcactgcagcctccaactcctgggctcaagtgagccttcctcctcagccttctgagtagctgggactacaggcgcacaccactgtgaccagtgaccagttaattttttaattgttttgtagggataggatctcactatgtttcccaggctggtcttgaactcctggtctcaagagatacactcactttgtcctcccaaagtgttggggttacaggcatgagccaccacactgggcctctactgtagacacatctttataaaattaggaagaagtgaaaaaaaaaaataagggatgtgatcccttatgtgaaattttgtttttcctaagttgaaaaatgatagaacaatgtgtaatgtgtacaagtgacaacaaaataaaggagagtttcactacttcttaagataaaccctggagcagactacctgaaaatattaggaaattttcactttagagatgcgtgagatcgggcagccagaaaatgacacagcaaggaaggactcctgtcatttgatgacactcatagtctgtcagggcattaatcagggtatagaaatataacatctgtcacaaattctgtgagatgttcttgctgatttcttctatatacagtgttattttgacattctgtatataaaatatggcactttttatccatgatcagattttcaaaatgatatctgtgccagtgacctacatttttgtctcacttgacaatgacttggggctctttccctattagatcatatagggaatgtctacctcattctcttttttgccattttcatggtacgatttatattatataatagggatgtgctataatttatctggtgtcttccatattggtagacaaatatatttgtcctcattttttactattacttagaacgctgtaattaatgccgcaaatattgctcaaatgtaatttctttacgatagtttcctagtattggaattgttgaattaaatagtatatgtacttgaaatttattcattacttcattcaaacatgcaacaaattttatgaaacatttactcctacgtcagacatggttttagaattagagatttagtcatgaacaaattaaaccgaattcctgtacttttgcagcttaaataccagtggcaaaaccagacaatcaataagtaaacgagtatatttttgtgagtatgtgtgtatataaaatatgaaaagagagatacagcagcatagcatcaaatagtgatgagttctctgaaaaaaaaaaacagcagggtttgggaatgaaggacaacgtggctgctgtcagttagggtgctcagagatggccaatgtgaaaagatttgacagaggtctggatataatgaaagaatctgaatttctggggtggggtgttccacgtgaggttctaaggcagaatcatccttgctgtgctcagggatgagtatctggagtgcaatgggcagtggaagaggattggggatcccagtggagatgtagtcaaaggctggtaggaaataccagtggagaggaaggtgggatagtagaaacgttggattttactctaagaatgatcagaactcattggattgttttgagccgaaatgtgacatgatctcatttgtatttaaaatataattttggttgcttttttgaaaaaatagactataacacagcagtattggaagcagaaatctcattggagaggctaccatagcaggctagacaaaagataagagtgccttggagtaattgttctaaacactttgggaggcccaggtgggaggaactcttgaagccaggagtttgagaccagcctgaggtacatagcaagactctctctctacaaacaaagttttaaaaaaagattagctgggcatagtagtgtgtgcctgtagtcttagctacttaggaggcggaagcaagaggatctcttgagcccaggaattggaggctgcagtgagctgcaatcctgtcattgtacttcagcctgggagacagagctagaccctgtcccctcccacaccaaaaactaaaaatcatttaaaatgttcataaattcagccacattgtcctccaatatgactttatcaaacctgtcttttgccagcagtatatgaaattctccttcccaaatcctcaaaagcagtgggtctccatcactttttttgtgctcggcatcatacttggcgtagagttggcctttgatcattatctgttgaatcgatgaatgaatttaagtgtcactattttgatgcttagcgatataaacttgttttgatttgcatggtttgaacttcaagatcttttcttacactgcttagaaacttgtttttcttcatgaaatacctgttcatgacatttatttattttgctcttagattttcttatgtatatgttggacttcttgatgttttccaggtattataactttgttatgtgttgtgtatgtggcagtatgtggtttttgtagactttatttttgtgtctttgatagtaccaagttgtagattttgatggatacattttatacatttttggttttgtgatcattttgggaaagttagcagtctttcatatccaatattttattctcactatttggttatatacagatagaaaaatgaagatttagcatgtttaagaaatttaaggacaaacaagttctgtgaatctcatggtcagccctttctccaaagggttgatttttcaggtgtgcttcatcatgtaatatgaaaaaacagaaagtagtgtgactggggagaatggaaggatagtatatgaagcatgattacaattttatttaatattaaaaactaccttatagctagatgtatggatgattttttattttccttatacgttctgtaatttccattttttcgaagtgtatgctgtgtgtgtgagagtgtgtgtctgtgtgtgtaatgagacattaaagtggccctagtccagcaggaaatgacatgtctggggcaacagggtagcaaaacttcagataaggaaatctgaaatgaacagatgcccaggcttgaacagagagtagaattaagtggtttttcattggaattatggagggagaatgaaatttctgaaaatcataatggaatgggaggaaaaaaagtaaacatagttaaaaaaaaaaacgatcatttaaagaagactaggaaatgagtaaaaagactgagggaggaaggggaattctaagtgaaacgataggggtccatatcacattgcatcctgttaaagctgtgtcaaaagtgtatgtttcttggccaatggagtactggatatggaagacatcttctagttagggcagcaatacatgacagacatcgataatcagtcagagccctccttcacttctttgctaagtcttcacagtgcaggtcttaagtaaaatgtgtcagggttgatgctcaaacataaactgtgtcccgcgtaactgtagttgcacgccctcattgtgaatataagtaagacagagaaagatcttgtcctcagtcgtccagctctgattatatctacctttaccaagtacatttcactatgattattttggtgctcattatccatttgatttctccttggatgattactttgtggagcaacagaaagagcatttgtaggatgactcaggaataaacctgttgatatagtttggttgcttgtttccgtcaaatctcatgttgaaatgtttccccaatgttggaggtgggcctaatgggaggtgtttgtatcaggggggtgggtggattccccatgaatggcttggtgccatacccatggtatgagtgagttctagctctggcagttcacaggagagctccttgtttaaaggtgtctggcacctcctcttctctctctcttgctccctctgttcccatgtgacatgccagctccccctttaccttctgccataagtggaaacttcctgaggctctcatgagaagcagacgctgacactgtgcttctcatatagcctgcagaaccgtcagtcaagcaaacctcttttcttaataaattatccagtctcaggtattcctctatagcaaggcaaattaaccagtatacctgcattgagttgcctccaggatgactggcctatgtgtccttgattgcttcatctgtaaaaaggcatgttgatactggacttactgggtagataaatccccattgttttttgatctatgcttctatgattcttatgagactgcaaccctagaataaaattttggcaaaatgatagcaaataacacagccatttataatggaaaactagagaaatttccatttaataagtcaaaatatgattttagagccagcatgaacacacatcagccatttttcacttctgtaataatattaatgtctacatttatttgctgtatagaaaatagtgctcattgcacattagttttttgagattcaggaaaaacaaatcatcagcactctttgacacttaatccatctcaatgtcattatatctttgaattaagttattaattacccttaattaaattcattttaaatggtggtgctttcattcctaagtgcttattttgtaattcctggaaaagtcataaattccactcagtttaacaaatattaaaatcatttcatgcaaggtatagttctagatattttaggtaaccactaatttcatatcccttggggtaaaaaaataaacatgcttccatctcttgtaactataacttctgttagagctttgctcttggcttatactttctggaagaagtaggggttggcacaggaatgggagaggaaatgatctcaatgattaaaagaaggatttgaccaattcctaagggcaagcaaacatcttgaagtttaaagaaatctcatacacgtctttctatagggagcattagatgatggataatgggctgtgttgccaacataacttttacattagatggtgtaattaatttttcatgattttgtttattgagactatgtatttagaatgaaattatatcagaaataacctagtgcaaggaattattcaaggccaaacttaagttctaatatgtttggtatctagcggcctccaggcatagcaggtatacagctaagaggcatggagcaatttcagtttctttaggcggcttttctctcaattatttctcttactttgtctttgagagacgcaagcaatctccagttgggcccttgggacaaggcatggtggccaatatgctaaatggcagctgatccatacactgtttctttctctctgtctctgtctctctaaatacaaaaaaaaagttgaaaattaaaaaaaaattttttttaattattctatttacctactcttgttatgtaagtgtggtatgtgtattacctattggcttcacttttaggtcatggaggacaatgatctacatcctaataggtggttttccagttttcctcagagtaggaaagattgtctaggaaaaatgaaaaataggagatgaaggtgaatgctaactcactgctctttgtggagagtgctctacacattatcattattattgttatttttcgagacagaatcttgctctgtcacccaggctggagtgcagtggcacgatctcggctcactgcaagctccgcctcccgcgttcatgccattctcctgcctcagcctcccgagtagctgggactacaggcacccgccaccacacccggctaattttttgtgtttttagtagagacagggtttcaccgtgttagccaggatggtctcgatctcatgacctcgtgatccgaccgccttggcctcccaaagtgctgggattacaggtatacaccttatttaaagccacaggagatgagaaagaagtgatggtctattcccaaaaccttaacaattatttctcctgaaggcataatgcatctttaagtgctaatattttttaaactgcgatagaagtatttcatgatgcgaaacaaatgctgtctaatggtgtggggctcataagtattttgcagaaattaagttgcacagaacatcccaggcatttcctgtagtagccacaaacaggtgattaggttgcctggggaaaggacatagcaaaggctttggttggtgacttccttgagttgcctggattttgcaaacagtggtgcactcatcaaatttttactgcagatgtgtgtatatgtgtgtttgtgtatatgtgttgataaaacgtgttgtattaattaatgaattctttatgaataatagactttatttttattttttatttttttttttgagatggagttccactctttcgcgatctcggctcactgcaacctccgcctcccgggttcaagtgattcttctgcctcagcctcccgaatagctgggattacaggtgcctgccacaacgcccagctaatttttctatttttagtagaggtggagtttcaccaggttggccaggctggtctcgaactccaggtgatccacccgcctcagcctcccaaagtgctgggattacaggcatgagccactgtgcctggcctagactttatatttaagagcagttttaggttcacagcaaaattgaaaggaaggtacagagatttcccatatacctactgcccccacacatgcaccaccttccacattatcaatatcctccaccaaagggatacatttgttattattattacccagaatccatagttgacattagggttcactctagattttgtatattctgtgggttttaacaaatatgtaacgacatgcacccaccaatacagaatagtttcattgccgtaaaaattctctgtgctctgtctattcatccctctccacccccaaacccctggcaatcactggtctttttactgtctccatgcatttgccttttctaggaagtcagagttggatttctacagtacctagagttttaaaattggcttctttcacttagcaatatgcatttaaatttccttcatatcttttcatggcttgatagaatgctgaataatattctgttgcctggatgtaccaccagatataggtatcctatatctggattccgactgaaggacatcttggttgcttccaagttttgggaactatgaataaagatttatttggttatgaatcaagctgctataaataaagaaatcaagctgtgttttatgtttcaatttcaaaaaatctaacaatttcatagaaaaatctgcatgcctttttctttggagaaatcacaaaagaacagtcagtaccgggaggtctgcaaggcaatccacagaggctgttgaagaatggcatggactttgcgtgggcctgagttctgcattcacagtggctcccatcccagtccccatcctcatacatcctgctcacacacacttgactcttcatgacacctccttatactataagcatttgagtttgcatctcctagggagatgggaactaattggttaattgttattttaagggttttgccttgccttcaacaaccctgggttcttggtgcatagtttgccctttatctcttcagttaatgttgctaagtcaagatttttatttggctggggggacggaaaggaatgagggtatgaatctatattattatagatagattgcattatatgaccccatatatgaccccagcatcttagaccctccttctgccaccttcccatgtggcagagccaagacccttctgcagctggtcctcacttctctttttccctcttgccacatgctcctacagcctggtgatccctgtcccatctcttgccaaatgttttgctctgagctaagtgagtaactaagtttcaaaggaagctaccatatttaatacagtgcatgaggaagaccaatttctgatttttgcttagccacagttttctttttcttttttttgttttaacctttaaaaaaaatgtggtaaaatatatataacatttatcatttaaccattcaaaagtatggtttaaccattcacgagaggcattagatacattcacaatactgtgcaaacatcaccactatctatacccaaaactttttcatcatcaacaaaatctctatccattaaacaataagtccctcttctttcttccttccctccccaacatccccagccttggtaacctgtattctactttctgtctctatgaattaggatgctttgagtgttctgggatctggtcctcactgtcagctaaactctccaagtaatcgtcactgcaatattatttttgttttgttttgtttttctggagttctgagagtgaggaatccattatcaatgacctatagcatgaacatttttgtgggggaatgtgtgtaaaggtatatagacatgaatatttgatgatctgacatcccacggtttaaacctagatggggcttctgtaaatatgaactcaaggctttaggagcctcccaagatctgacattccaagagtagagaagaatggagagacacccatgatggaattatctgttgcagacaagaacacaaagatagctttcttcatttagaactaactttgaggactttacatagacagaaatgttctgtctccttttttttttccagttacagggaatgttttccacttgtggtccctaaaaatgcagaaatatcatagggagtgaaagttaccttgtttctttaactgccgcaatctggcctcactcaacatgtagcaaatgccagaatgatagatgatagattatagtgatgtcgccctaggttaacagtctttctaggtaaggtacttctatatctgaattgaaaagtagggcagctattgcctcagatttgggattttaattacattgtttccacgtatgatattctttctaagaatgtctctagcacttagtctctgctttatacaatctaccagttaattatgtatttatgatgtaagtaatttggaggcacagagaaaggcagtggggccatttctccgcatggtcttggtctgggtgcatgtgccacatgattcacattatttacataaggaatggctttactgatttgaactggctgagtttgcttgcttttaaaactgcaacaagccaggtgctgtgccatgcacctatagtcccaaatgctagagaggctgaggtaggaggatggcttgagtccaggcgttttgagtctagcctgggcgacatagcttgagcccatatctaaaaccaaaaataagtgataataaataaataaattcaatttagatttggtttccaaggtacaactgtcaaacatctttttaaatgcaaatatttcatgtttcattttaacctaaggttgtgtcatccatttaaaatactttacagaaattggcctaactgcttatgtgtactgcttgatttgctttcctctttgttgttgtaagaaaaatgtcccactcactagtctggattactctgttgcaaaattaagggatctgaaacatctcaagctttaaaaatgtttgagcatagcttctcactaaaataatgagccctgtgtatctattgcaccgtaatctctaatatttaaaatgataaaggacttctagttcaaacccattattttcaattgagaaaattaaagtccactgaggtgtagtcaattgccagctagtgagtcaaggaagtgttaaggttatcgtcttatgctagatagagcctgggaaaggaggtgggtcttggaaatttgcggttcataacagggttgtctgtggggctggcagaaaggtagaatatgactctgtggatagagatcagggaaaaaataaagactgcagatttggggctgtatccatgtataggaaacatgagcctgacaaaaaatagagatgcagaatgagggaaggtgtggtcacttctgtaaaaatctttcaaacactgatttttgaacaattcattgctcttctgcagttgaaagaatcccaaaggaatgacacctgaatggaaaacctccaaagatcccttctggttggaggccctgggtctccaattgacccttcaaatatattattctgttcttttgtgcatttctctttttattgcaaagaaagaaaattaaaactatcatgaatgtatttaaaaattttattagtctgaacatgaccactttattgattactttattgattatgacattctttttttttttcagacggggtcttgctttgtcaccaggctagggtgcagtggtacaatcatagctcacactgtctctcaaattcctggactcaagcgatcctccctccatagcctcccaaagtactgggattacgagtgtgagccaccatacctggctgattatgaaactcttaaataccactcacacacatgacttaaggctatttttgatgatgtacagtagcactgtatccattcctggacaccagtctttgaagagtgtttggctctgtcccatatatacctattgatacaatgttttgagtgtttatttatgatataaatatatttatatttttataagtaatatacataattgctataatattaagtatcatgtacattatagggaggagtctcagaagtaatttaaggaagatgtatttgtttgtctccagcctgagtggtgcaactacatgagcttacagcattccttgaattacagatggctcatacctggggatacagattagcctttcctcctgtgaactgaaggcttccatttgtctaggtactgggtagagataattttagtgtctctttgaggaatattatctttagcaaacttgttttctctcttacaacctctcctttacaccatttgttaatttttttttttttttttttgagacagagtttcgctcttgtccaggctggagtccaatggtgcgatctcggcccaccacaacctccacctcctaggttcgagtgattctcctccctcagcctcccgagtagctgggattacaggcatgcgccaccatgcccggctaatgtttttttttgttttttttgttttttgcatttttaatagagatggggtttcgctgtgttggtcaggctggtctcaaactcccgacctcaggtgatccacctgccttggcctcccaaagtgctgggattacaggcctcagccactgtgcctggaccatttgttaatttaaaatgacacatttatggctgggtgtggtggctcactcctgtaatcacagcacttcgggaggctgaggcgggcggattatctgaggttgggagttcgagaccagcctggccaacatggcgaaatcccatctctactaaaaatacaaaaattagctgggtgtggtggcgtgtgcctgtagtcccagctactcaggaggctgaggcaggagaattgcttgaacctgggaggcagaggttgcagtgagccgagattgcgccactgcactccatccagggtgacagagccagactcagtctcaaaaacaaaaaagacacatttataatactagtaagggcacattcaatatttaaaaagaatctcatacagttttcatttttgcatattacttttcagtatattcattagagtcctaaaatttatactatcttgtattgtactcttttgacttcagaatgtcatcaaaaaatttgcttctgttaacaatataatcctactttcaattgctttttaataatcttgggtactttgagactgtaatttagctagtctccaaatttgggacatatatgagatttttttttttttttgccatcatagagaactctacatgaatcaggtttctgtctttatccttcatgcttctgttgcactatttccttggtgtgacatgccgtagtcaagaagtagaagcatgtattcttgtcattataatttcctatttttctgtgaacattttgaaatactgggttggtgtagctcttagctgtcactgtcaaatcacccccagtgtgagcccacacgttcaagattatttctctttttctcatttcaactctgagttagttccaggatatggttgtatctctgcaagattgtcagctccactgagtgcctccactcacatagatgagtggggtccctgcccagtgcttcaggtagcagttcttctctacacaatcaatgatgttaccactgcatgaagctccctgaaagtgtgcgtatggagtagtcctcgcacacaggctgaaagacatatctagctatgttgggcaactagtcccctcagaaaatgattgcctcaggaacaaatatttaagttgaattgttaagtgtggctgctaccatcgtcaatggaagagaaccaaagcactcgctattacaaaggggcctctagtggccaaaactctcagctctgaacgttgttcctttgtcctcctctctacatcctcctgagagaatggtacttcaagatttcatagggcaaatctccaacttccttttggaaaatacatgctttaccaggacgcatcatctgtccacgtgaggaacaatggaggagaccataatactctaaatctggaatatgtcagttgacctgaatgccatggggagattcagctgaccatataggataagcagggtgttgtggtctcttttgtgttgctataatagaatttctgagactgagtaattcataaagaacagatttatttatattgttctgggggctgagaaatccaaggtcaaggggctcacatctggtgagggccttcgtgtgagggcatcaccccatggtggaaggacagagggcaagcaaccatgcatgagagagagaagaaaagggggacagactcacacttttattaggaacccccttctttgaaaaccagcctactcccatggtcaagacattaacccattcacctcttttttttttctttttgagatggagtttcattcttgttgcccaggctggagtgcaatggtgcagtcttggctcactgcaaccttcgccttctgggttcaagcaattctcctacctcagcctcccaagtaaccaggattacaggtgcctgccatcaggcccggctaatttttttgtatttttagtagaggctgggtttcaccatgttggccaggctagtctcgaactctgacctcaggtgatctgcccgcctaagcctcccaaaatactgggcttacaggcatgagccaccgctcctgaccatcccatttacctcttaggggtcccacctcttagcactgttgcactggggattaaatattcaacaaatgaccttttaaaaggacacgttcaaaccacagcacaatggcactacaagttagtttccatttacaaatgagcactgaaaccaataagatttgggtaactgatatggaatcacaaaaaaaaatctaacctgaagcaattttacagtaagttggttatactgtcaactagtgtgacagtaatagaattggagtctcaggagaaagaatatctacaatgagttcatctctaggtattttgagcttttctttttgaacttcctctacgagagttttaaagtaagttatccatattttacagaaaacttcaaggattctagctggaaggagaagaaattatcaagtttctaaatatcagatcttactttattcactatttgaagtgatggaaatcagattgcagttcaatttttttttttaaagactgtactcctctcctctgccaaagctcatgcaaagccaggaaaacaaatattgatttttattttctctcatctctttcagtccaacctggttttcagtagtattgaaatcagatgtacttcatattgatctgggtcttgaaccagtataatccctgattaacacaattgaaataaccatcatcaaggtggttctaaagatagagaggaaacagtgtggacgcaatacatttctgctgtttgctgtggcttcctggttctgtgaattatgcattggatcttgggcaggaaaaaatacagccagatcctgccatcattttatgaaattagggtgagatatttggaagtagcacgcccatcaccaacactgtcaaatcattagtccatctgaatgtctggtaaatttaggtagaaatatttggtgttatcattgccttccaatctcgtctatctcaaatgctgtatcaatgttgactctgacaatagtaagggaaggctggacaatctggaaggatgggtaaggcttagcacaggtgaacagctgtatatataaccagaaaggcagggctatcaatttgagtcctctgtctataagagagggtgaactttacaagataaatatgccttatcctcagctgagcacagaagacccattaaagcaaaaaggtaactcaggcaataatcatcatggcttggtaaaaagcagttctgatagacttaatctttaaggcagaaggaggacaggctggtggttttatgagaaagtaatgaatccttttgacaattgtattaagactttatggacataagacctaagtcagagttttaaaaatggttctcagagacactgttttggctttgttcttagtcacatcccttcattcaggttagctatctgcctgccctgcaaagcccgcctcttttgtgaagcttttcctgaccacaccagtatctgctgatttatcatcttctctaatctctgaactaactgttcagagggatgaacacagtaaatactaatacatgccgtatacactccaccctctcccggcctctcaagttgtttgtaaactctattttatagttacagtccacccaacagtacaggtggactcagcaccatgtgtgtttaatttgttgccccactttgccagatccatacaacatcaatggtatcatatttatcattgcactgcccattgtctgtagtattctgcagtgcacatagtacaaaacattacagctgaattttaaagaatgatttaacattcaccagggaaattatgaaatacaatccatatgaaatatgtaatccttagcattaggacagcttctttctaaaccctgacttgtcctcacctctcaaaggtcatgtgtaatcctagccactctcaaatgtttttgtccactccaggtctcagcctattagcacatcctagttccctggccatgttgattggttcagaactagttacagtatccaattaaaaacaatgagatttttttcttgaggtatctgagaaaaagatgttcacatttcccggctggatccgaaacctcagagtaggtagggtctggagagcctgtcctcaacttgctcttccccaatgcctgggatgaaacagagtaaagtgaaggagagaaactgattcatgatgattacatggtgcattctacttccctgtaggatgtagagaaagacgattccctactttcctacttctcaagttatatgggtcaattgatttctttttcttttacatctttttcttttctccttcctttcttccttcttaatttcctgccttcaaagcttctttcatttctttttttatttaacttaagcctacttggactgtgatttctctcacttttcactaagagtactactcaatacccaacttgagttgatcctgtttctctttggtacaagagtacaattgtagtttattcatatgttcatagttggacaaattaatgtgtctacagcccaacggcaaactattgatataaatgcagtatctcctgtttttctaaatggtgtccagatttgtagagatacatttgtctatgttgtgagaattgaaagcctttcatgcataacttgaatgctctgtttatgtaagtaatttggcatttcttttcatgtgcaaagggttcctttgattttgaatgcacaggctgtgacactaagcagagaagatgagaatcagaccggggaagaataaatttcctttgtatatgactatacaaagttttaaaactttatctccctcagctcggtatttaatagacattgaagacaggaagtagggagctgtgactggctgtactcgacttttccccaatacagttattcaatttctatatatgctaccctgacaggcttatttcaattttagtcataaacaaaatttacgttttgacttgaagtgggtcaaaatcagtgtcagcattttgttttgtaatatgcccttcacatcgttgtacctttgccataatcagccagagtcagagaaaattatcatccctccctagtgggtgctcaacttaaaaaccagcagagaagatttttttttttgtaaagaatcaacaaagtatgaaaatgaaatgtcaaatgatgaaaattatatgattcaggtttgggatgctggatctttattttcagggacttatttcaaatccaggtacaagtctacagttagttttaggaattttagtgagcaatgggcaaataagttaatgctagtaaaagattgccatattactgcattttgttattgaaatgctaatttataagtagcaaattagcatttaaaaagacacaatttttgttaaaatagtggcctttcttacattttgtattagagctttactttttttctgctttaagcttcacaatgcagtggcagcttgtttcacttgagcgttcttattgattataactgctggtatgaggcaatctgtgcttcccttgtgttctgcctaacagaggttatttctttgcatgatatggagatggatatggaagaatctgggctgtcagggaaggaagtgagagccagagaggagaaagcagccagggggtggagtggtgagcctaattcccagctcttagacaatgagatagctaggagcaaacctctgttcattcttgcctgacagttgtcatggcaactctcaatccagtgacctcttttagttctctaataaacgagttgaatatttgttaagtttttggtttgtttgtttttagtatctaattctctttgagatgatcaagctgcaaactgattccataccttattgattcagactttgtaaaaagatattatgcaaagttgaagatgtgtagatttaaacatttcaatctttcttttaagagaattttctccacaataggaaggcatgtgggcattttatggtcttagccaacataagcattacacttatgaaattggtctagccttctaggctcctgccccagtgaggtccctcctcagttctgtgatcataggcaagtcagttccctgccccagctctttgccctcttccatggcatggtggggttgaaattgacagagtcacatttcccttctgactttaaagctttctgactctgaatacataatatataagtgggtttctctttttgacattacatactgtagtgaagtacagtcctgtaacaggcatctgcagactacagacgcacgttaccatgcagattgctattaatgtacagttctctccatttaatttgctgtggtttccaagactactatattttttattgagaatactaatagcctgtgtgaggtatgaaatgaatacatagtttcaataggactgggttagtgactgttggagaaaatatcttgaattagagtacactgttttattgtttatagctatcagaaagttctcctgtgaggacaataatataatgatctctatcctactatgtgctacactttatttaattggttgagatgaacatatgttgattaagaataaatttttaaaattttactaaatttgagaaaagcaacaaagtatgaggaaaacatatatgccaacaactgaaaataaaaagcaggtgattccattgttttttaatgaagcaccagtcatttccgttgggattagaatccattgtgctaggaaagtatttacagcatgatgctgccatatttgaataaagaagggacgagtggattgcctaaatggggttgaaaccatgtcaggagcacattacaacataaaccagaactcagctgagtatccaataatgttaatgggggcaaaacaagacttattaccatttgaactctatatctgaaatgggaatccgataacatggcagaaataacgtttggtttgggactaaaaacatcctagagtgtatctaagggcttaagtattcatgaattttgtttgtacacttacattatgtgttgtgttagaaaaggcagaaaaaggtagtgcttcatgtttggttgcaaagactcctgcctcagccttgttacacaggagcataacggtgcagtgtgaagcatttaagacaaaaacgttttagagtcagatctgagtaaaatctgagatttcacacttccagcagtgtaacctaagactagtttgttttttttttaatttctcctgaggcaaaattttatttttttctctttcttccatttcattgtaaccttttaaaaattgtgataagatatacataatatttttcagtgcaaccattcaaacatgtggcttatccattgatcggtagtcttagatacattcacaatgtcgcgtaactattatcactgtctatgtccccgattttcctatcatctccaaaaacaactttgtaaccatgaaagaataacttctccttctcctcctcctcatgccacctgcagccatggtaacctctattgtactttctgtctctatgaatttgcctgttttaggtagctcatgtaagtgtaatcatatatttgtccttcagtgtctggtgtatttcactaagcatggtttcaaggtccattcatgttctagcatttttcaagatttccttcctttttaaggctgaattggattccattgcatgcatataccacactttatctgttcatctgctaaatagttgatttggttgcctctgtcccttggctgttgtgaataatgctcccaagaccagctgtacaaacagatattcgagtctctgatttcaattttgtgtgtatatgccaaaaaattgaattgctgagtcatatggtaattctatttttagtgtttttgaggaactaccatgctgtttccacagcagctgcgccattcctgccaacaatgcataggtgttctaatttctccacgttctcaccgacacttgtgattttgtgtttttattttaaataataaccatcttaatggatgtgaaacagtaagttggatttgcactttcccagtagtcaattatgttgagtgtcccctcatgcacctattagtcatcaatatatcttacttggagaaatggtgtgaaagggtatacagttttcaaggttgaaacatgacaataattaggatgattggacaatttagtgaagaaaaaatattattactatagttaacatttttttggcacttattccgtgccaggctgttactaatgctataagtgcatgatctcaatcaacttttactatgaagttgaagactatgaaggtgcctttattatgatttctattgttcacttaaagacatggcatctcagggtcaacaagtatcttggcttatgttgcacagcttgtaagtggcagaaacctgatgcaaattagttctgcctgacttcaaagcatttggctgttaactgctatgccatgttgtctaatgcgtggcttgttgcctaatagcctgtcaatatatgttaaaaatccattatccccaccctcaactgaacccacacacacacacgcacacacacatgcacatgcacattcctcaactttcaagcaccattttcatcctagtataaaatgatacccacccaccccctacccaagattcccaatcttcagtcatctgtcatgtaatttcattcatgtgccttggagaggattccctaaatttatttccacaaagaagcatatcttaattaggtctgttgggagatcattctacatgggtctcttgtatttctgtttctatagcaggagaagcactatgaaatttgtttggattatatgttgaaggacatttgtagagcaaataaccttggagaaggagatactatgtctttcttccagtatattaaagacaaggtttccatttggggaaaaagtcagggcattttcttgcagcccagtgtaaaagatccaggttcttgaagattggaattcctcagctttgacacaaactactaaattgggcagcatctgcctggactgcttggtgctgttgctgccatggaacataaaggggtgagggaaactggtgcaaacatgaagtgcatattacttgtcttttttctttccatgtgcaatgaaggcccagaagtcttgggtcttctgccagcattcatgaaactgtggcagggtcacctgttagcttgcaagtgagataaagccttagactcattactcttcttgtcaaggtctaagatttattagtagccttccatgcacaccaggcagcatgctttacctatatcatttcattcatgcactctgagatatttactgttatcatcctcattattcagataaggacacaatgcctaaacaattaacttactaggctgtctgatacaatgtgttcctcataagtcaaatgtagatcccacagcaacttggtatatagcatctgataacttgaactaaacataccatttatctggctaatacacatgaaggtgtagactcatgtacgcaaacattttgtacccttctaccattgtgaatcttgcacctcaggtgccaatctctttaacttgggttatgagaaattgtagttaaagttggcagtaattaataattttgagcttattccagtttaattaaccatatatatgtaattactggggcattatgaaagacttctgacattgaggaaatagatatgaaagcagcatccatacgcacttgattctcacttgaattacactcattgctcatatgccaggtggggtgtctcacaacaacccacttcttgtatcaaataatgcatgtgttagaatccataaaacatgaatttctaatcatgtaggccacctcttcactggagaatcttctctctaagctttaggctttatatttcaatagaacattttaatacatatctagatgattaaatataagccttccatgacagtgtccaggtgggagaacctgtcaggggagataatttgggagtggagaaccaatatttttggcagccaccactgacataccctaacttgtcttgtcaactgtccttggtttgagacactgagtgtgtggaaattgctttaatgcctttgaaatgtccaaaacgccaaatattacttaaaatgtaaagcctcttcatagttaacaaagagacattaaccttctgctttgtaaactccatgtaaattacgacacaaatgtaaggtattattatactcacatttattgacaatgaaaccttttactaggtgcttttggttcatattgaaagagactttgagagccattaatggatattaaagaggtgtaatttaaatatgtctacataataaaagcatgaaattagaagtatattatctttttatgagatttgtatgtttgtgatggccttatattgaattgcagtcactaatcatcagagaaatgcaaattaaaaccatcatgagacactgtcttacagcatcagaatgactattattaaaaagtcaaaatataacagatgccgatgagcatgcgcaaaataggaacacttgtgcactgttgctggaaatgtaaattagcacaatctctatggtaaaaagtatgacgatttctcagagaactagaaatagatctaccttttgatctagcagttcccctgctgggtatctacccaaaggaaaagaaattgctatatcaaaaagaaacctgcatttgtatgtttatcacaataggaaaaggaaaagtacagaatcaatctaagtgtccatcaatggatggttggataaagaaaatgtgatgtgtgtatatatatctgtcacatttcatggcgagatatatatatcacatttcatggtgtatgtatatattcagccattaaaacagggtgaaatcatgtttcttgcagcaacatattaatagatgggactagaggtcattatcttaagtgaaacaactcagaaacagaaagtcaaatactgcatgttctcacatataagtggacctaaataatgtgtagaaatggacatacagtatggaataatagacactggagactcagaagggtgagagggagttgagggctgtgaaattacttaatggttacaatgcacattatttgggggatagttacactaaaagccctgacttgacccctatgcaatatattcatgtggcataactggacttgtgccccataaatttatacaattttttttaaatgaaaaacctggagctttcccttggctccttttcctggaagctttctcacatcctactgtgtgaaatttggatgcttttgggaacctgaagataaaggctatagctacaccttaaggatgcccaagctgtttctgtaaggagactgagcttgtgaggtttttaatagaaaaatgcgaactaacctagcagccctggacttcatgtttctgtacttttacatgggagaaaaataagctttctatcttgcttaagccaaaaaaaaaaaatgagagaagcattttatttgtaaagatggtgttggggagcttgactgcaatattctgttcacctaatcactaataaaataaatgcaggaaagctaaaagtccacatgagtatcactagcatcagctaaatcaagaaggctggggaggggcagaaaacaatgctatacatttcaacaattgctgatcagggaaacagagacaaggttgaggcatcaatcctattcctggcccgattgctcaagttcactaaagtctgagaattctcaccgatattcccaaatctgaagtgaagtgaaatcagtgatatcccaagctgacctgaactagctgctgggaaaggaccagtgaagtgggaaacaggaaccagaggctaattctctgtcaatgcatcaggttctccagggctaacaggaatagtgttaaaacttaactcactcttccctctctgggaatgagctaaatctcaatactaagcagagtgaatcctgcacagcaaattaaacaaattctcaaaaagggagcagagccaaggtatgccagccatgaatgaattgacagtaaactgagcacttcaacgtggggaatcttcaagaaatgttcagccttcaaaatgtagctggtaggggaaaacaaataagtctcatatgcaaataagtagaaagagagactcacagaaactgacctgcataatgtcatgaaagtgaaaatctggacagcattggcaagacgaaaaggaacagaatggaaactataatcgcaattcgagccagtaggtaggtgggcaggaacaaattgatggaacatagcatggaatctgtaagaaaatgtaacctaagacggaagaaaattttcgatactttatgctaaaaaatacatgaacatggctgggcacagtggctcatgcctgtaatcccagcactttgggaggctgaggtgggcagatcatgaggtcaagagattgagaccatctgcgccaacatggtgaaaccccatctctactaaaaatacaacaaattagctgggcatggtggcacatgcctgtagtcccagctacttcggaggctgaggcaggaggatcgcttgaacctgggaggtagaggttgcagtgagccgagattgcactcctgcactccagcctggtgacagagcgagagtctcaaaaaacgaacaaacaaaaaaaaaacaacaacaaccacaaaaaaaacatgaacatgagttaaactggagccccgtcactcaccaaaaagaacacaacaagaaaaagagatgaacaaagagagtgagaaacttgaacaaaaaatattgaagactaagataatacaatctcaaaatgactaagtaaaattgacaagcatatagaacaaatataactgaaaattgacttattgatatggaagacaggcatatataaccacagccaatgaacatacaagaaaaatataaagcaaagagagaaaagatgatagtttttcagagcttagaaagataagccaacataataatccattgcctatgagacagaaaagcctacacatgaaattgcaaaaggtattaaaatataatagaataagccctgatttatcccaagataatgcctagttagattattttctttgcacagatttaaaagaaaaaatttaaaatttacatacagtaaaattccctttttgaggtgcagttttctgagttttgacaaatgcatagagtaactaccaccacgattagatacagaacaatttccttatcccaaaatttcttttgtgttacccatttatagttaattcctctcttttttcaatctctggcaactgtgtcgctataattttgttacctgttcctataattttggctttttcagaatgtcatatgaatgaaaatgaacactcttgagtctgaattctttcacttagcataatgtatttgagaatcatcctttcatttattaatatgtcttcatatttttgctcagtgatattcaattgtatctttgtttcatcatttgtttatctattcccttattgaaagacgtttatgttattttcagtttccagatggttacacacacacacacacacacacacacactcccagatacatatatatatatctgtaatatatatatatatatatctgtaatatatatatctgtaatatatatatgtgatatgtatctgtaatatatatgttagatacagatatatgttatatatatctgtgatatatatatataggcacacccatatatataaagctcttatgcacattagcatatggcttttgggtgaacatacagtttgatttatcttaggtaaagacctaggagtggaattgctgggtcatatgatacatgcatgtttaacttcataagaaactgccatactattttgcattatcaccagcagtgagtgagagttcttgttgtgccacattcctgacagcatttggtagtatcagatgtttttgtttgttttttaaaaattgtagccattctaatacatgtgtagtagtatgttgtggttttaatttacatttgcctaatgaataatggtgttgaacatatgtttgtgattatttgccaccagtatatattctttgataaagtctctgtttgggtccacttttaatcgggtcatttgtttccttatcatttcattttgaaagtagttattgttaagtctgaaaccgagaaggatctgagaccttatcctattgtgagctaacaatgtagtctgccacatatatacacacacacacacacacacacacacacacacatcatatatatgtctcatatatagatgtctcatatatagatgcctcatgtctcatatatagatgtcatgtatgtatatgtcatatatatatataaagctcttatgcacattagcatactggcttttgggtgaacatacacagacatatagatgtcatctatatatatatgtcatatatagatgtcatatatatatgtcatttatatatatgtcatatatatagatatagatgtcatctatatatatgacatatatatagatgacatctatatgacatctgtatatgagaaatgaggctttctggagcagaaaagcaaacaacttattgctcttggcaaaaacagccagagcagcatcttagtgctgctccttgagcccccttggggtggtgtagtgagaatcacaggtctttctccacatacaatctgtgttagagggtacagtgtaggagaagacgatggatacactatctctagcttccaaggcattttctattcaaatagagcccctgctcaagaaacctgtactgtgcagaaatatgaaaatcttcaatgagaattttctcccagtaagcatatattctggatatggttcttttttgttgttgttagatatgtgatttgcaagtatttttcccaatttgtggtttgtcttatttatttatttagatagcatctttttttgtttttgtttttgaggcggagtcctgttctgtcatccaggctggagcgcagtggtgcgatctcggctcactgcaagctccacctcctgggttcacaccattctcctgcctcagcctcccgagtagctgggactgcaggtgcccgccaccatgcctggctaatttttttggtatttttagtagagatggggtttcaccgtgttagccaggatggtctcgatctcctgacctcgtgatctgcccgcattgacctcccaaagtgctgggattacaggcgtgagccaccacacctggcctaggtagcatcttgacagagcaaagattttaattttataaattatgatttcttttttctttcatggattatggttttgctgttctgtataaaaaaaactttgcctaacttactgtaggtcatgaagattttctcttttttctcaagttttataattgtacattttacacttacaactatcaaaaattttgagttaatatttttataaaacataaaatttggttaggattcacttttttgataactgattgttccaccaaaatttcttgaattgcctgtgtaggaaaaatcacttgaacatatatatgtgggtttctttctggagcctattcaattgcattgatccatttatcaacactttttccaattccacattgtcttaatatggtagcttttactatggtagcttttactaggtagtcttgaaaccaggtattgtgagtccacaaactttgctgtttgttttcaaagttgttttggctattctcattcccttgactttctgtcaaaattttagaataaacttgttggtatttacaataaactctactggtaccttgaggtattgtgtagactctattgatcaatttttaggaacattgatatcttattaatattgtctctaagctgggcactgtggctcacatctctaatatcaacactttgggagactgaagagggaggattgcttgagcccaggagtttgagatcagcatggcaagacttcctctctacaaaaatgtaaaacaaaaacaaaaacaaaaaaacaacttagctggtcccagtgccacatgcctatactcctagatgcttggaagtttgatgggggagggttgcttgagcccaggagttcaagtatgcagtgagctgtgattccatcatggtactccagttaggtgacagaacaataccctgtctctaatatatatatatatataatttaaaaaaacaagtaaaatattgtctcctgttctatgaagatggaatacctctttatttaattaggtcttctttaatttctgtcctcaatattttgtcacttccagaatttttgcacattttttatttgatacactagaattcaattttaatggaatagtaaatgttgcttatcttttatttccaatatttcattgaaaacatattgaaatatgacttttttggattctatggctttgctatattaccatattacttccaggagcttttttgtggatgcctttgaacttcctatgtagacaatggtgtcttctattaataggaacaatgttctttctatcttccaagtctttgtatatctccctcttcctttttttcagccttttattgcactggctgggatgtttattataatgttgaatacgatgatgtataatggactttcttcctttgttcttgaacttaggagaaatcattcagtctttcaactttaaatataacagtagtctaagcatttgttttcttttggtgtgagttgcatgatcaggttaaggaagttcccatctattttagtgttctgagatttaatctgtcaaatctgtcagttttttgtatatattttgatatggtcctgatttaacttagtctcttactatggtgattgattgattttaaaatattaagtcatctttgtgttaccaggataaactatacttggtaatatatttggtattaccatttatatatagtgctgtttttggttttctaatattttttgtgcatttttgtgtctgtgttcaacaggaatattggcctgtcattttcttttactaaaatgcctttgtccttttttattaggaagattttttttggcctcataaaattgagaagtgtcttagaagagaatatgtggaattgttatcatttgttctttaaattgttagaattctccagtgaaatgatcgaggtctggagttttatttgttggaaagtttttaacacacattagttctttagtagatatagaactcttcaggttatctgttcttgagtaagttttgctaatttgcctcactcaaggaattggcacatttcctctatagacacagacagatttgtattattctcttattatttttcttttaatgtccataaggtctcagtggtgttccttttgtattcttgatactgatatttgtgataactctctttgttttggtcaatctgtctagagtttcatcaactttattatttttcagttaaagcagcttttgatttaattgattttctcttttgcttttcagttttctatttcagtaatatcaacttattattgacaccattgatatgtttattatgtatttccttctgctttctttaggcctaaattgctcctcattttctagtttcttatgacagtagcttaggttatttattttagggctttcttattttctaatatgactcaatgctgtaaattttctgcaaatattaatttagctgtcccacatatcctgatagattttatttttatttatatttagatcaaaatactttatagttcattttggttgtcttacttaacccattaattatttagggatatgttagcttctaaatcattgtggaatcaccaatgatttttatgtaattgatttacagttcaactctgttatgctaagagatcatactttgtatgactttaattattttaaatttgctaagggttgtttaataagcaaggaaagggtctatcttggagaatatttcatggttacttgaaaatgtctattactgttggattattttctaaatgcatttacatcagtttggtcgatactgtggttcaagtctcccatattgttgctgattttctgtatgttgtatggattaatgagagagaagttttgaaatcttaaagaataatttgggacttttccatatctccttccagttctatcagtttttgtcttattttacagttctgtatatatgtgtgcgtatatatatatatatacgcacacatatatatgcacatataaatgtaatgtgtgtgtatatatgtgtgtatacatatatatatgtgtattcatatatatatatgtgtattcatatatatatatgtgtattcatatatatatatatatatatatatatatatatatgaatgtaatgtcttcttgggtaattgagccttttattcatcaagtaatggtcctcaatatccctaggaattttcctgttttatagtgaaatttgtctgatattgatatagccatcccatcattctttggtgtttatatagtttaactttctcctttattttacttttagcctgtccatgttattatatttaaagtgcatttcttgaagtcattgcatagtagggcctttttttaatgaaatctgacaatccattttgttatttgttgttgttagatcatttatatacagtaattattgacatggttttatttaggtttagcttttttattagttagattttttttccctccatttttgttccagtgttcccactttcctgctttttgggggcattatttgaatatttttatcatgatattttaattattggccttttgggatatatattttatattatacccacacaaataaatatacacacacagtatgtgtaggtgtttatatgatgttactctacataaatatacatttctaacttttcacagtctacttaaaagttaatacctttttttactgcaaacaaaatcgggatgccttccaactgtatagatttttaattttcccctttatcttactattgtaataaatattctatctatatacattgaaaactccaccatatattttaattttaactttcacactaatgcacattaaaatcagagaaaaagtctactatattattcgatatttaccattctgttgttctgccttcattttggaagtttgaggcttctcactaatattatttttctttcatctgaagtacttccgtcagcatttctttcagaacatatttattcttgaggaattatttcagactatcttcatctgagaatatctttattttatcttccttcttaaagaatatttttattgggcttagtattctgggctggtcttttcttcagcactttaagtatattgttttatgatcttcctgcctccatagtttctgatgaaaaattcagagtcatgattttttcattcctttatatgtaatgtgccatatttttgtggctcttttcagacatttggttatgaggtttctattctttgtatagaatctattctttgtatagaattggtagattcaaagtaattttgggttgagttctgaacatattgtgacattatggatctttcaaaaatcctctgaatgatattgcttgttttaaaagcaagcagtcaacttaggtttggactgtgagtgttgtctcaccttctgtgggtgattgatccaatgtcagttatgttttaaaacctttgttactctatatttgactgtcctaaaaatacatcactcttctgttattctggaacttaggtggtattttatatcatatttttactttcaaagcctttgacatgcttctttgggtctattacatgcgtgttctacttagcagtggctcagaaattttgttggtttatacacagaattaagcaattcttgtctctagctctctctgctccaagattcacctcaaagtctgcagctctcaagggcctcctccagttctgaggccagagagatgggttttttcctttggcttttacgtgcctgggctgccactaccattatcatcacaggagtgcattctgccaccgggaaagacaaggtgagaaaaaagaagagggaaaagaaacaaacaaacaaataaataagtagggattcccccatactctatggttcatgggggccctctttcccagcgatctactagaaagatttttctcgtgcctttttttttttttaatttttatacctgctgtatgtgttttaattagtccaccctcatgtcaaagttgggtgttaaggaaataatttaaaaagtgcactttccctcatactgtttgttcttcaatttttttgacttttgtctctcatttgcctgccaatatttacttttcagaagtaattttctttttgtatttctgttcagagattttagccataatcagtgaaagaggttggcaatagcaggcttatagcattttggccacagcagaagcccaggttaggatattaaacttataaattaaagaatgtgttagctatacagccatgagatgctggccgcttaataggagaatactgggccagctcctgtcatctctatttcaacagattgttcttaaaaaggagaaaatatctacacatatcagaggaaaagagagtgggatacaaaataatatatatttggccaagctgtcatttaggaagcagggagacaatatttgtaaaatttgtaaaaaaatcaagaactttgttgccactatccgtcttcagtaaaactgttcttagacaagataaagcaatatgaggaactctgaaatgttataggaatgtgctgtgtgaaaaaggtagtcagcatttaaaacatcaataaagaaatacagaatgaacaattgtggatattatggttatgaaataaaataaagcataaatcttaacattgtttattgaagatagtatgtgttatacgattgcaatttaaaaaatatgtgtatcaatctctccattaatatacctgtctgtatttaaatttgcatgtgcatatacacatgtaaatttatacacatgtaaattcacacatactacacacacagatgttagaattgaagctttatagtgttgattatgaaaaggaattattgcttttataatcacataaaacactttaatatcaaacacttaactttatttgagctggtggttttacatgtttcttttgaggacacatttatatttaaatctgatgcttaacctgtaaacatgaagggtttcatatggaaaaataaacaggttatggttgtagataatagaggaatatttaggaatatacaatattttctgaggttatagataatatttcactagaaaaacgtgaattcaatggaaatagaatctttgttattaaaaagtattggagctattctatggctatggaatacagattatgatgggctcatcaattttcattatagaattggcagattcaagtgcagcaaagtttgaacataatcaaaggtgcactgagttcatctgactgcctcattacctgtttgcatcctgtacaagtagaaagcccgatattgtaagctctcaattaactgaatagggtttgttcgctagcatcaggtattataaatttctctctaacttgagtttgagtagtatcagaggtagtgtggagtaagtgatgtcctccctgtatcttcccattcttctaggataggggaccctgtctggcattgcagcattaatatatgtacatggaataagttgttgaaagataaaagtagatactttgctactttgtgtagaggaggttcttgttatttgtattgtgtttgacatttatttgtttgtttgcttgttgatgccctacgtcatcctctgaatgatttgaggcatctgtaatgaatacatacactatctgtccatttttcttctctctgtttcacataatcttacaatttgagatattatcaataaattacatgtcaatatgaaaatagacataaatgataacaatcaagaacactgagataacagggataaaggaatgtcaaaaacattgacaattaggaagaaatagaaacatccagaatttccacgaatactgcagatatgacgcagtaaaatccaagacacactgctcggtatgcaaagccttatgtcatatttaatggcttttcagttgagtgatggtgactgattccatgcatccatgacctgagggatatttattacaacaaagatctgttcttctggggtctagttatttgggcatctgatttagtgagcacatctatttccaatactttccactaaccttgtattgacagttttagacctgctgagtccaaggctgacatagaccaacactgcagcctagttagcaaggcttatctaaggcaactgagtgttgaacagaggggcctgacctttggtgacaattgaaatgtaaggtcagtcagagactcagtactgaacattaagccaaatgaaccagctgtggaaagggttaggctcaagctgtgaaaccaggagttcctccaccagtgttgctgagccaagggcatagatgctagaagttagacccaggagggttcaccacaaggccacagttcatatcaactaattgtatactcttaaatacaaatcaggcttataaacccaggatccctttcagaatctcaatcacctaaggttaggctagttgttaagctcatttgctctagatttttattttgaaaatgcataattagactttttttttttttttgagatggagtctcattctgtcacctaggctggagtaaagttgcacaatcttggctcactgcaacctccgcctcctgggttcaagtgattctcctgcctcagcctcccaagtagctgggactgcaggcgcgcaccaccatgcccagctaatttttgtattttgggtagagacaggttttctccatgttggccaggctggtctcgaactcctgacctcaaatgatccgcctgcctcggcctccaaaagtactgggatttacaggtgcgagccactgcacctggcttaattagacattttttatccagggatctacaaaaatatttctgagaagatgcactctgctataaggtatcttgcaaaaagagaaatgaaaacaatctttgcccaaaatgttacacagttagatttaatatagtcccatttggtgtagcaatttatttccttctccacttaaagaacccctgtaagctaggcattgtctaaggcatgagaggagctagacatgggcacattattcaaagccatacaaaacattaatacaggtggataatctattatttgaaatattttgggaccagaagtgtttcagattttggattctttttctcagattttggaatgcttgcattacacttactggttaaccatcccaaatctgaaaatccctaatccaaaatactccaatgaacatttccttttaatctcatgtcggcattcaaaatgttttaaattttggaaacttggattttggatttttagattaggatgattcaacttgtaccagactgaatagaaaatgtagcaacatgctaaggaagtcataaataggataaataagatttagttgtgaccataaatggaagatgttgctgataaggaccatgaaatctggaagatccaacttttgcgtaaatagcacatgtcacttagaaagcatgtattatatgccaatttctgggtactctccacagactattttacttattttaaaaaaaattttacaggtggaaaaacagaaaaaaattaattttcccaatatataacaaaacttcagtgatgtagcagaactaggattcagatgcacagcttgaggaagttgcatcaggcttcttagatacttgtagaaaataaactgtatgatcattacactattgttgcacggggctagtcatttagtaggagcttaatacatttctctttttctgtaaagccatctttctgtctttgttgaatgaatgagtgtaacaatcactgtggaaaatagaggagggagtcaaaaaaagaaaaatgtatgtttaaaaaacagagtaaacagttgagtttacatagcttcctttttttctcccctaaactgtggaaatatccaggtaaggttggtaagtaagagaagctgaaaaacgaaaacatcaagggtacttattaaatgagggtgatggccagcttatccattgccacggctgacgcagccgtctgtgaggtctactttggcaatttgctctttagagatcttttctgtgcatgggcttcctgcctgaggttggatctgttcaacatggccttgccacttaaatgtgacaccaagccatctgatatgcccagatgaagaacgacaaagtaatcagataagtttataatctcaatgcacagttagaaaacatctggctattacagatgatttagactcatctatgatattaatattggtcttcatcccatgatatttccaggacacagacaggggtattttgcaagctgttactgatctatttgctaatatgtaaacaaattttcctgtgctcttctggatgattgtagcacagagaattgatttatagtgttttgtcaagacctccaatgtcctagattgaacaagtgagtgctgacttagtgtgactgtactggaagtctgtgaggagctggagataaatggaaatgtcaccaggatgcatggatgcctgtctctctgctacccttcacttcctctttccttagccatgaagctttgctaattaaattgaccttccttttttgataatctgaatataaatattgacaccatgctcagtattgtgagacaaacaaggaggatttaggctactaatgtcaatttcataaataattgattgcaaaaataatgaagatagtagtagttgtagtagtagaagtaattacagtagtagtattagcagcaagaataatcctagcgttcataatagctagcctgattgttgggtaggagatgagcactttgatgttccttacagaaggtttgcttagcaatgagtgaaagctcaggcagaagagtaccatgtggccacagcctggatatggtatatttatatttacccagagtggcctctgatccaatctccttatccccagttaattcctgctatatgagcaacataaattcactcttttaataacaaaccttgggagggctaactctctgggccattacccttcactagaatggaagctacctgtggacaggggctgggttttattcaccagggtatacctaggggacacccagtacagagcctggcacacagatgggattgatgcacatttcttgaataaaagaaccaattatactagtcgctaatgtcagaagaattatgatgtggtcaacttatttcctgatgttacctccacaacagccaagtttccaaggaatgagtagaacatgggagattccaggcacagggctcttggtcttagggagcaaggttgagctacaggaacatggtgagtgattgaagaaggccacaggaaagccaaacgggacaatcatctggacaaattaagttccagattttgcaacaatcatgaccatttatttagtcaacactttagtaggtacagaaaatactgctaagcgctctatcctattttatctttccagtgaatagatgaaagcagattattattccaattttatagttaaagattccaaggtttatagaggcttattgtgttgctctaggaaacaaagctaaagaataagattgtgtgtgtgtgtgtgtgtgtgtgtgtgtgtgtgtgtgtgtgtatatatatattttcagatcaaattgattccaatgctctgaacttaaagcaccaggttacactgagtcattagctagatatttatgtttatactgtccattgtttctgactttctcttcaattaataataatattaagtgaccatttagtgattttcaaacactgtaacatgtaatttcctgaatcttcgcatttaatcctcataacaagccttcaaattcagtactagtatccccatgcagcaggtgcagaactaaagaacacagtttcacagtttgaccaagatcgtgcagcttgtaagcaatcaacttggcacttgtgacctggctgtctgatactagaataagtgctcttcttaatcactgtgattcattgattcctgaatttaactaatttttggtgacaatatgctaggtaatggaaaagcagtggtgaaacaacaacagtcaaattcccttctccaaagacaatacacaaaacaggtcaagcatgtctgtttgatggtcataagtgctacagagacaaaattgggaaagggtaaagggaggctacaattggaataccagggccaggaataacctcgttttgccaggataagaaggttacaattgagggagccatacagatatctatggtgagtatatattgggccaagggaaaatcaaataaaaaatcctttggatgagactgggcctgatgaaggaaagaaatgggtgatcatatggagtgaacatgggtgggtggtaggagatgatgttagagagataacaggagaccagattgtataaaatgttgccagccacttcaggatttgagcttttatgttgagtgagatcagaagccattggagaatcttatgagaggaataagactatctcattattaaagtggatagtgtgttgtcgacagagcagggagaggtaacaacggaaacacagagacgagagacgaggctattccatgaaatgatggcttggaccaaagtggtaaaggtgtcagggaggaaagtagtcagatattaatatagtttttttttaataagtgagattttgttatgaattgaatatggagtaaggaagaaagagaggagtcaaagagcaactagaaggtgaggagactccagggagaacagtgtggggagatgagtaggtttatgtcagatgtctttatatctattagatgtctactagacatcccagtggaggtatcaaaagggtaatggcctacaggcatttgaaattcaagggagatgtgtggatcagagaggtaaatattgaagtcatcagaatatagttgttattgaaagccattaaatcaggatcaccaggcaagtaagtttagatagagaaaagaaaaaaaaagtgctgctttcaaagttactttgctaacaaagatgttaccaaagaggattataggaattctctgttgtgcttttgcaacttttctgttgcaaaacttttctgttgcctgtaagaaaagagagcattctgtgagtctaaagttagttgaaaatcaaaaattttgaaaacatgttcccacatgtggacatactcccttgggttggatctggcctctttagaaggaaataagatacttgcttattttggtctgaaccccagactttattcagaaagcttatacttgaattatcttcttgaacatcttatcacttcgtcagcttacactgagtttgtggtcaactgagttccaaggcatattctaataatctcttcttaaaccaggtctccctcattgtatctttcaaaaatgaatttactttttgacaaccctgatgatagatcatacattatacataataaatattcttaattgagtttgatacaaacacgaccgagtgctttgggctctgctttcagtgtcatagcatttaccagttaattagcatgccctctatgctgttatctgaggcttccaacattctgtcatcttttagatcactggagaaggtccagggaagcataggtactcacccagagtcagcattttcattgaccaagatctatccatgaactcttttttgctttcatccagctgtgaatttacctaccacaattatccagcagcccacatttattcatgatattattaaatatataatgagggtctctattaaattctttgatgaaataaaaacaccatctgactataacatttcttagtctaccagcccagtaggcctatcaaattatgaagcttgtcttgtcttgactaatttgcaatgaatttacactttacactgccttctagtgatcaatgtattttgttattatagcaccacaaatcatctatttaatagtccttttctactaatccaataatatgaggttgctcatgtgaattatgcaaatataagaatgtcttaggctgggcatggtggctcatggctgtaatcctactgctttgggaggccaaggcaggaggatcacttgagaccaggagtttgagactatcctgggcaatataacaagacccctgtcactgtaaaaaaaataaaaaacagctgggcatggtggcacatgcctggggtcccagctactcaggaggctggtgcaggagaattgcttgagcccaaagttcgaggctgcaataagctgtgatcacatcactacactccagcttgggcaacagagtgagaccctgtcttaaaaaagaaaacaaaagaaaacaaaacaccttgcctaccctttctgttttcgcttattattatttttttatgagaagaaacctggtagacctaacataggggtcttccagagaggtgcatactgtgaagttgtggggttattctttttttaggaagatgagggaacaggcctcataggaatcaaacagaaaatgttactgcctttgtttccgattttatgggcaatagctgtttttgatggtgtagttaaactccacaggaggcagtttaaatggcagaattaaatgtagtttggtgaaaatgtttatcaagtattttcttaaacagtttataatttgcacatttcttttctaaatggcgcttcttcattagtgcagactagagcttgctacagactgctaatgaattatgacacatctattattcatggatcttacaaatttaggtgacattctgaaggtcaccctatggtttataatcccaaatgatcttgttgaagaagctccataatgtcaccaactgtaaccatagtcacctgatttttgccaggtcgtgaccatgctttgtttgcaatggatatgtatttcagtgatatcacagcctcctgagagaaggcacagtgctcagacaagctgtaatggctattctgtgtggtttcatgtggccatgcctagtataggttgtgccccatggttgatgaaataagatgcctagctcatcttctcccccacactgctcctggtcttcctgcatgctggcctcagtgtattgttttctgaaacaaatcatttcttgatttgcttatatttaccaagattttgacagaattgaagacagttggaggaacttgggataatagtaatgtagggattgtaaggcattcgggaaaataaatagcaacagcaaatacttttatgctccaggcagtgggctaaatgcttttcatgtgttatctcatttaatccccacaacaaccctatggagatgggaactgttttacaggtgagaaaactaagggcagaaatgtcaaattgtccaacatcactgagttgttcagtgataaaactgtgatgccagccgttgtcctatggtcccagagcccccgctcctgatcactatgcagtgccaccacgtagcttttcgctgatggagaccatgccaaacatgaattctaactgtgtgttcagagatggtgttcagcaattttaatgtgattagatgcaaccgtgtgatactgctgatatctgactatttttacataaaaagatgtggtgatttgggttatgaaaaactgagagactgaggaaatgacaacaattgcaagcaactgagaagacctgctgaatcgatgcaacatgatacattggattggaccctggaacagataaaagacatcagtgaaaatactggtgacatctgaataaggtctatagtttagctcatagtggtgaaccaatgtaaatttcctggttttgataattgcactaggtaagatgttaattttaggggaagcaaggtgaagggtatgtgaaaatactctgcagtatatttgcaacttttctgtaaatctagaattattgcaaaatacagttctatttagaaagtcaaatcaacagataatttcatgtggtttaaccttaattatatatttacaaagatcttaaatatttgtaacaatcacttcttatttaattatagaaacatgtatgctttctttaattatcatcctgtaaccaccagccttctccctactccccagctctaggcaaccactaatctactttgtctgtctatcagtctccctgctctggacgttttacatgaatggaattctgtaatatgtggtcttttgtgactgacatctttgatttagcgtaatgttttcaaggatcattcgtctatcatcactttgttcctttttatggacaaacaatattccattgcatagatataccccattttgttcattcatctcttaggtgatgcatatttgagttgttcacaccttttggctattatgaataatgctactgtaacattagtgtgccaatttctttgtgggaaaatattttcatttcttttagatatatacttagttttaattcaattacttctaactcgaccccggaggaaagtctcttggagagaaggaataaaagaacctgaacgtgctaaaaaattcaaattattttcagagattactacctctgtgagtctcagtttattagcatcctttatagataagctgtgcctgtaagaaaagaggggtagtaaacaaacacgtatacacacacatgcttgcacaagcatgtcgtcaaaagtgtctccttcaaagaagacttctggagaaaaaaagcataaaccttctcaagctattgccattgttcgggaaattgggtaattcatctttaggaatttcttctgactgatatttggtcatactagaaaaactgaccatttctaacagcttttgcccctgcttaaacaagattgcttctggccatctctaaaaattaaatttcccctggaaactgttctttcatgatgtgtttttggaatattggctgtggttaggagggtaagctcctcaagggccaagcctgtttcctcctttctggcagagcaccttcatacaacgcaagtactcaacgtgtttgctaaactgacatcaattgaaatcattgaatcatagcacttttttggaggacgtgtctgtcttctcaatcgctcagttttcttttggaaaaaggcaggttatagagcaattcattaatcatttgctgtcccaatgttccttcctgcttttaatagcaaaaatgagtcaagacctgatcttctgaacacatcacttgctgcctacatgaggcagtggagacttagagtacccctgtggcctgctcctcctacatctcttcttttgatccctagtccttgctgaccttctgtagaggcttattcacccagcttgtgggttgaggtgatgctttcttcctatttactgagagcttccccacctctccctagatactgcataaatgcaaggaaatttccaagaggccccttcaagtataaccacagcttttcaatcatttgacattttggtcatagagcagaaccaaattatgtagtcaactatagacaccatgcctgattgaaacttgtatcaaaaatcccaagaactccaataactcttagttttactttgtactgtttttaaggaggctgatttacagcagccttttttctgaattttatttgaggaaaaatatgccctcctgccatcattccagctcctgtgacactgaggcctttggttcccttacttatatcagggtatctggggcttggttgttaatttggtgtaatgtgattaattgagacaggcatacactcaggcctaaaagataatcaaatccagaaggggaaactgaggtcctgaaagggaaaaatgggcatttacactagagtcaaaagtggatatcaggggtttggtcctgttatagaaaagttctttttctgacatttcttgatgttctatctagcctagtggactagcactaagtactgggtgactgctcagtaaatgcctctggtgggcagatggcacagaagtgcttaggggatgttctgcctcatacagagcatccaactctcctacatggatggagactcacatgatcctggtccctgcagagaaaatctgtgcatttaccacaactttgactcctaagaagctctgactttttgactaaagtcaatgggggtattttgtcagcaggcacctttaaccaggctacacttacaaattcttgtaaatcaaattttgtacaagtagatacttttataacccatcatattttaacctcaacaaagtggattctttacatccagaaatgaaacaataatgactacattattccaaaaaaaatttttttagtagttagatccaggtggatttgatggcctgattttgtcccttatactttgatatatagtatccctttatttatttaccacaagaaaaaaacccttaaaaggagggaaggagggcatctttaatagccaagcttaaaattaaaggcgactgaaatattaattcttaaacagcgctctggtttcctgagtagccaagaaagcactatttagctctttttttagactttacaggaataggaagtgctatgtatcaacatttaatttagaaactatgaatgctttcagatatgccatcttaaatgtttttacttagggtgagggttatttcagtgacatttactttgtttttgggcataattagaggatgaggatctcatataagtgcattttaaaataacgaaagcttgctcatttaagagcctatattttttatttcaaatgtttctgaagtaaatcttttaaaaatgtaattgtccaatcatttccttttgtaaacaaaagtgtttaatagacatataactcttcctaatggtccatggcaggacgcccaagtgaatctttgtgtctgggaaacttagatttgaagagaaccccagttcacccagtccatctccctcatcttcctgcccgatttatagaagaaagatttgaggagctacttccagccaaatgccctgagatttcttcggtactcttctccttccagacatccatgacctggagctttgctttcattatagaagtgctcagttgctcaggctttgccctcaacaagctgcaacccactctctttctagggttcacctcaaggagctgctgactggcccccaatgcagccccacaatgtacccctacagctcttgcacacccacttttctgtctgggattcctttccatctggtccaccttagatggccgatagccaccttgctttatctgtcataggtcatatttaaggataatttcctctggggaactttccaactcccccaggcggaaatagttcctccctacattacatccttgattttctctatgagttctcctctctcagctcttggccacatttgtaccataccttgagtgtccatctgtctttgctcactcactcattgagcttaaggattcaatccaactcatctttcctgttcccaatctgataactagcagctctctatggggataaattaattgtgggacaaagaagatactctaaatccacatcactcactcacttccaatccctctcagatgagcttcttttaatttaattcttatcaagttcttttaatttaatttttgtcaaatacttgatatcttgaatgatgaggagagaattggagagtctctgtgtgtgtgtctctgtgtgtaggaagacaagtcacatattctcaccctgagacatagtttttttctgccagccaaggagaaggagcttcctgcccatcagagaccccaccctttttacctggcagggtgtgctgtgaggcattgcccagagtgtcttgtgcaacttggggaaacgttgaaatcacaacctacagctaacaggaactactgaaccttacagagttttgtagcccatgcctaatattaatatactctgtctcctagatcacctcaaagtagtgaattttagctcttttgtctgcatgtctgcaccatgcgtatttgttgccatttgttttcattgccattgtgaagccacactgcctgtgcttacatttcgccttcattacttgatcattcaacctctcagttcttctgtttcctcactgataaaaatggtggtgtaaagactaaatggattattgtacagaaaatgttgggaagagggccggtagcaccaacacagcctgaagcatgctcgctattattactgttaagatgactgtccaacttggaaccctcacttcctgactcactgttattgtcttgggatttgctttgtctaccctctggtagctggtagaatcagactggctcaattgactgtaataagtaaggccagagtgattaggcttttagtaaggactctaaaaaaaaaaaaaaaactaaaaaatctatatgtgctctggagcacatataattttaggctgtgggttagcatccaggggccctcttttttcctttctgattcatgcctctgttaagaatagtcgaagttgccagaaaagtgatttttgtataagtaagagaggtgagatcatgttaaattaggaatcagagtcaagaaaagatgagaagctttatttagaatgagatttgggctgaaaatgactgtagatgtttttcttttttaatagtgtgagaaatacagccacaggtttgaaatggaactatttaaacgtttattttagcctagttgaaaaaagaagagagccagtctcttcctagacctgaacaatttatctttaggatgtataaagaaagtgagagactgcatgaccttgttttctctgaaattttcgctaccttgctttctgtctcttttttgctttttttgaggggggataatgtgtattgttaatgctgaaaatagtaaatgatttttttttctttgcaatagatgtggaaagttaataaaaaacaggcatcatagcctatgcaagtgtgttacagagtacagctaggtgagtgactcctgatgagccttttctccatagttctggaatcccatagactgatcatatctagatccagagttgcctatagttggtccttcaaacaggctggcctgtccgcagaacatttacagacacagtctggcctctaggcaaagttctcaactgagtgtcctgcttaaaggcaagttgtgaatttctttttaatttttattttattgtaaattgacaacttataatttcatgtatttatgaggtacaaagtgatgtttgatttatgaatgcaatgtgcaatacttaaataaatgtaacaaatatatcaatacatcaaacacttattttttgtggtgagaacatttaaaattatgaaaagatgaaatattgaattatgaaattatgaaatatacaatactgtattcttaaccatatttaccatgctgtgcaatagacctcaaaaccactgtaacaacgacaacaatgtctcctatctgaggttgagtttggttcttgaaatttgtctctctctttctttctctattgacttatctagctccctgaatatttttactgatttcacaaaaaaagttataaaatgatggaaggttttatctgccttgctcatttaatcttcacaatagccatgttagatacacatcattacccttattctaaagataaataaatggaggcatgaaaaatataaataagttacccaactttatagccagaaagtgttaaagtgagaactatagcagggtctttctgaccctggggatcttgtgttcttggctactcactacctagaaaccctaaataaattaagttctaaacttatgagatttttgccaaatgatacatagctgccaaaaaagaaccacttgaatttggacaaatatattcctgtaaatatacagggaggcttctttatcttttgacttgttatcagcttgactctcttattgataaagtggcaccatgttgagaaagagtgaaaataaagttttatgtgttacagtatttctaaaatttggaatgacgtttctgaaaacacgagcacctcttgtcctcctttctgccatccttgaatagaaatgatatggctggaaattcagggtaatggagaaagaaccctgtgctatttgtcacgacctctacttctgtgattcctccccctaaatacaaagataatgttttaagggaatatgacacagttacttcctaaaataaatgaagaattttaatgtaaatgaacgtattattttaaagaaagatggattatgatggtctgttggataaattcaggaaaagaactctttgcctaaaattacccagcctgttcaagatgcagtgatatatatggaacagctcctccacagaaagtccgagccgtttcttctcccagaaagtgacccagtaaaaatgctaaatatacacccaggtcctctctaactgtataggcaataatggaaagagatgactcagccttgtaacgacaggagacccgtggaaatggtttcttttactggagttggtctaaatttctgttttgttaaaagttttaggctatttaaaatcaatagtaatatttaacctatattttacaaaaaagaaatacatttgtttctttaaagaagttcagagatagctgactaatgagcttattaacccagggtttataatagaatgctgaaattatacacaggataagatgcatgatacctccttggctttggttttcttattttttcagggaatcacataagtcaagttagatattaaatttgcctgtatacatttatttttaaagaagatgtttcaggatatttcaattgtactgtctacaaagaatacctctggcatccaaaatggaattacctcttttgagggaccaaattgcacagaaaaccaggataagattctatctagtcatacaaatgcaagaaggtttgcttggcatttctgtggactaatattgaattccatggagtcagttgccaagagctggagattcagggtcatggatatgcttcccacagctccttctctgcatacggggagtctcattactgcctgtctgtattcctgcacatgcctccgtacccatgtttctgcctgtttcttcttcttcttccctttttttcatttgctgaaataatggatgccagtttaacttactttgttttgaagcagtacgatcaaaatctgttccagtgtacctacagcatccccactgccatgatgtaatatttgtctccatcattccagttactctacagacagttccaactggtaaattctctggtgctcgatgcctcagtgaaacttacccatctgctctgtgtaactccagtaaaccctagattccaccaccacagtttagtctggctgcaggacattcttcctcttacaccctcttgctcctggtgacatcataatcatcttctaacattggtcctcaatttcacccacctcccagatactttcaaaggagttgtatgagagagggatggggcatagactaagggacacatattggatctgccattgtacctgtaagcaattgacttgatcaatgtcttggtttcctcagttttaaacttggaagaaatagtccctcaaagagagaattcaggaacataccctacatgaactgctttctgcagagtagacagtaatgaggggtcaattcctgttttcttcccaacactcactgctttcctcattaggattgcgtgtcctctggtgctactagagaactgaacattgcatcgtttgaactttagatgacatgttagagttttgggagatattggggctttgtgctgactttttggttttattttattttgttttgtttttgagacaaggccttgctctgttgcccaggctggagtgcagtgatgaaatcatagctcactgcagcctcaaacttctgggctcaaacggtcctcccacctcagcctccagagtagctgggactacaggtacatgcctggctattttttaaattttttttatagagatggtgtctcactgtgttgcacagactagtttcaaacccctgggctccagcaatcctcctgttttggcctcccaaagtgctaggattataggcatgagccatcatggctgtcctgtgcttacttcatgtgactgttttataacaaccccccaactccaagcaggaatatatgttttgcttctttctgttcctagcagtatgaccttgagtaagtcattctcaaggtcatactgtggttcagtctcatcggtaaaatgaggctaacaatagcactgactcttgagttgctgtgaggattatatgaattcacacacgtatttagaatagtgcctcacatggagtaagtgctctatccctttatgtttaatagtaactgattttttaattataaaaccttggtcctctgtggttcttataccaaactttttgcatgggtagggcactgatcttcttcatagcagtcagaaatcccatcattttagccaagttagttttttccccttggcatttggtttgctgctggcatagtatttgcttttcctgcttttgcttatggcacagatgcatgagttagcatgactcggactggtatgttagtgtgtttttgctccgtagtttgtcttcacagatacttggtcaaacttggccattacacagtctgatgatagctctgtttcctttatgttatcattctttcagtaatgagagttgaattctttctctctcctgcctcagatcctcaggtgacattgcacaagggcagctgcagccaatgccttgtccaggcagttatattagtgttatttctagacattgtctgccctgaatacctgttagcttcctgatcttggcatactagtctgaatgagataaaaggaaacataatggtctccagtgtataggattatttgactaaacaggaacttgccatgtgttatgtgtgtcaacaaattctcatttttcatgagttctttcaactctcttattaatttcctgtgatacaagctaatatttctggctctacaacccaacttctttttactacatgatgtccgctgtcattataacacctcttaatctctctttctgtctcttcctcaatccccaaatctgctctgtgttacctgctcagatttctctataagagaatagatcctaagccaaatattactttggcagtgaaaaaaaaaaacacataagaacaccaagtgaaaagctggtgaaatggattcacgtggaactatctttaaatcttggcaccacaatttttaccttgggaaattatgaactttggtctcctatgttattttaagacagaataagtagtatacccagagtacctgttacctttaaacatggctcagtaattgaaaggcatattactagaagtatttggagataattataatacttggaatatcaacagataaaaatactagttgatttttcccctgaacttcagagacactcatttgacctccaaaatagaatgccttgttcttgatactcattttttcgtttaatacattcagtgttcctgctgcaggtgccaaatgccagccttgagtttcgtgcttttaagtagaggtatagaaaacacagagcttatggagcccactctttctcagtttatgttactttcactgtgagcacctgcttactgtttggcaaactagacataactgttcagcatctgacggataaccctgctgaggacggacactggcatcctcctccaacacctccttctgtgttcctagtgtttgccctcaaacagtctccctgcaaaggtgggagcacctgaaactaggattgaagaattcagttcatccaaaattctgttctttcttctgctggtgtcattagtttttgaggcaagtctaaatcaaccaaatatagagtctggaattctaatatagtagatctgaatgttggctgaacagtggaatcgtctggaaaaccttaaaaggtataaatgcctggtcccaccccagagctctggagcatctggatctgtatgacctggaaggcagcaattggcattagtttcttccttgctttgctccccgaggttgcttgcattgacaggggaaaccaatttcatttgacatctgatactcaggactgccccgctattctcacccccttcaatgagatgcatactaattagatgtcaagaaaagatcaaatccttcagaccctcaataccactattgcgatgtcatttcaagtattttatctatctacttcatcacagtgatctgctttagatgataggtaacttgttttatctttgagattatattggtagcttaaatttcttggttacatcaccttgaaaggtgtaggttattgggaaattctgaataggatagcgttatggagaattggctttcgaactgatgaatcctgtatttggaatctaccatctttggcaggtaacttgaactctttgggactcttcatccacatctgtaaagtgggattaatagggctgtagtaattattaacttacattggatcagatatattttgtgaaaatccacacctaacccttgcctggaatatatgaagttctcccaaaatatatactttttaccccaatgagtaaggataaaaatatttaacaagtttggctaacacaggaacagaaaaccaaacactgcatgttctcactcgtaagtgaggcggaactttctgttcctacagggaggggaacgtcacacaacggggcctgtcggggggtggagggcaagaggagggagaacattaggacaaatacctaatgcatgaggggcttaaaacctagatgatgggttgatgtgtgcagcaaaccaccatggcacaggtatacctaagtaacaaacctgcatgttctgcacatgtatcccagaacttaaagtaaaaaaaaaaaaaaaagtttaacaagtttggatgccaaatatatgttttctaaggaaaaaaataccacagtataatctgttgctttctttcagccttgtgtcattcatcacagactatttacttgacacagcaaaacatcatatcatctaataatggcccgattgtcagcttctcaatagaccaatcatcatccccatttgacaagcacattttactcagaaatgacatcaaaatgcaatatttttcttgtcaagctgaactatgccatgcctactgactcctgtatattctcaatattcattacccttttacttggtctcacccttttgctgtcaaatcgcctcattttatttatttaataatctgacaaagatgaaagaaatattaccatgggcttatgagacaattgaaatgtcctttactgtcatcattttcatttagatgagagaggcatcccccggtcatgaatttaatttaagcaatgtctgcgtgttgaatgttttgttgtgcagctgtgtcagtgtgtgtgtttatgtgtgtgtgtgtgtttccaaaagtagtttcctgaggtagactttatgtacagccctcagattaagtgatcttcaccaaactctgctctttgttatattgcaaagacattattttaaatcattcagtctataaacctgaaataaaaccttactcaattctaagtggatgtcatttaatcaacataaatcatggctgtatatatttaacattacttaaattctgttaaagttttttgaaaaatgataactagctgggacacctctttttagtaaagataaattctgaagatcttaggcaagtgttcttcaacaaataccatcaatatgctggttaaccccaaatgtatatttttagtcttgacttctattataaggcacagactcctatatcaaattagcattgctttctccaaaatattgaactcatatgaggtatgtctgtgtggctgagatcatactcattatcttccctctccaggtggttccccttccaatgtccccggctcactagaccatgcttatatattctgaatactgcccagatttgtgtaattttctttatcttcaatgttgctaattcaagtcaaggcaccgtcaggtctccctggacttcagtatgctctgtggaagaaagatgtcattctctctgtttagcaattaatctattagatagcaagattattttttcaaaaggcctgtagggagaaagacaaggtgaaagatcttaattgtggtgaccatgaaatttattttacaaacaaggacgcttaagagtgaagggagcaactactgataattattccaggactatcgccatagaaaagattagtcccaggaaactggggtgttggacagccagatcttaatacttttcactagaaagtgaatttcaccattaatgaagacatagacttgaagaattaatgtagaaatgatcgataccttagataataaattaaatatcataaggttgttattaccacttaggaaaataaatttatttttctttaacaaataaattctaaaaatattattccctataatgtataatgagtaaatttaatttttttctacaaacatgtagaacaaacttgcagtaattatagggttatatttcatagaagctgcaacatgagacatacagaacaaaagctgggtggttatgaatcaagccattctagacaatcttttggcccagtagatgtcctagtagatgtttcggtagatcagccacaagttggtgatgacaaggcacagatagtatgcagagatttaattgaaattatcacttcattctgactgctgctctttattctttatagtaattggcatataaatattccttgatgccagaaagaccaaagaattaatttctcctttggccgcttctttgaactggcattttaacctctctacacattcatgtttcttctgttttaaggaagtgatgacatttattctgcctacttcataggactctaggaatatttaatggagtagtacagatgtgagttctctgcaacctgcgtaagttctttgcaaatgattggtgttatcataagtgctagactaccagcagcaaagggaggcctattttgctggttcataagagcccaggttggagacacagttggcagtacagaagggtgccctagtcgtaagctagacaaagccttgctcacagtcttcctctgtcacaatgttataacagtttcagtgaaatttgagatatggcattctcatgactatggtgagaaagttgttttgacttgttgttcaatccttgagcaaaaataagcctttcctaaagtctgcatgctgggtccctaacacttgaaggagatccatgggccatgcggcttcagctccatgcagagggtggctgcaggtgctgcaagggcagcttaagttctggacagtcatctctgttcaatggaatttgtaaggtcaaaaagtagacttaaaaccaaagtgatggggctgggggagtggagaggaatagaccctgcctatgtgaagttagtagtggaatagttctctcctgaaggtaaacctagttttcaaattgctttgtttattggttggcttctctacctgcatgaaaagtttatgcgttttagaacgtggcaaaacaagtggagcatgacttatgtttcataatgtacagagctgatttcctgagttccaggacaatgttcagccctttagtcccttgagaagttggttctctctctctcttatccataccctcctgaaacatacactcctctaaaactcatgttatcaccagaagtgtgataccaaagcttagttaatactttgggcacagatatttggctaacttccttgtaaatatgcacagtaaacctgagtggaagtgtgccaccctttccttcttcccagttggtgccaggacaggtggcatcagcctatcctagccacctgtctccagaaaccccagtctgccccagggtggactccttagcccacactctcagcacagccactgatcttgacaatgcaaaatgcaagcatttcagagacatagtggggcatccccaccctgctaggaccttcctctctcccaccctcttcagtgcttggaggctcggctccataggaaagaaaaagaagagtcactctgtttccttcatcataggaaatttaactacctcattttcaaatcatggagtggttcagtttggaaaagcctcaaagatcacttaaggtactgaaaatttacaaatgggaaaattgaagcccataaatagaaatctcttggctaagatcacgatgttaattaatgactgagttggacttgtgttcaggtctgctgtctagtcattggccttccttctacccgtcgtgattccaatggaagataaaatgtgtgctgggacacattttatcttacctagttccggacaatcatctttattaataatgcaccatcacttaagagtatgtgcataatggcattgcatttattttctttattgatcattatgaatatttcagtgctatttcatttttctaaggactgtcataaatggctaggcatgttttagagatctcaccttaaaaatgtttttaaaaactcaaattgtgtcatgaatatggaagagatacttttcagcagttgctggaaaatgacatgtgcatcccttatattaaaactcttactttctatatgccttcccagtaagtgcctcctgtactccagagaaaaccatttagaggttagattatgataaggaaatgccttttgcatttgttgtggaatgaataaaggatttatatctttaatgctgcattgaacaaatttgcagagaacattaaatattctttaccttgacatttctgatacccatgattttgataacctttgagtcatggattgttgattacaaatgccttatatgcgtctgactcaaaatatgataagaactcaaaccagaagcatttttaaaagcttgtttaaatttctggggttttttttgttcacttcaattatttaaggaatctgaataaacagattagcttttccactttgagtttacaattagggactggaacatttcagccaataataaccatgttgatgataaaagcacactgtgtgtatgctgtcatcttaatttgcttgagatttcggtaccctaaatttttgaaggtggagtctcactctgtcatccaggctggagtgcagtggcgtgatatcggctcactgcaacctcgcctctcgggttcaagcgattctcctgtctcagcctcgcaagtagctgtgattacagatgcctgccaccatgcccagctaatttttctatttttaggagagacggggtttcaccatttcggccaggctggtctcaaactcctgacctcaggtgacccacctgccttggcctcccaaagtgctgggattacaggcataagccactgcgccagggcagtgctctaaatttttaacataatgttctcaatacacagtattcctgtaaaaaccacaatactacattgtcagagggcacagttcacattcaatttccagtgatatatctgatttttattacatgcatggttagtttaaagttagtcttagaactcctttcattctggtttccttatctcctctatagatttccttgttttaattcttatgggtacatagttggtgtatgtatgtatgaggacatgagatattttgatacaggtgtgcaatgcaaaataatcacattagggtaaatgaaatagctatcacctaaagcatttattatttctttgttttatgaacatttcaattatactctttcagttatttatatatattgttgagatggagtctcactctgttgcccaggctggagtgtagtgcagtcatggctcactgcaacctccaccttccagattcaagtaattctcctggctcagcctcccaataggcatgctccaccatgcccggctaatttttgtatttttagtagagacgggatttcatcatgttggtcaggctggtctcgaactcctgacctcaagtgatcctcccacctctgcctcccaaagtgctgggattacaggtgtgagaacccacgcctgtcctagttatttttaaatgtgtaataaattatcattgactgtaatcaccctattctgctatcaaatactagatcttattcattctatcttaactatttttttgtaaccattaaccatccccactttccctgcccattaaccatcactacccttccaagcctctagtaaccatcattctactctctatctccatgcatgcaattgtttaatttttagcttccacagatgagtgagaacatgcaaagtttgtctttctgtgctccactgtgtatatgtatcatattttctttttttttgcttctccattcatattcttttattctatcaattttttagactatatgtatgtatcactttttctttatatatatatatttttattatactttaagttctagggtacatgtatgtgcatgacgtgcaggtttgttgcatatgtatacatgtgccttgttggtgtgctgcacccattaactcgtcatttacattaggtatatttcctaatgctatccctcccctctcccccaaccccacaacaggccccagtgtgtgatgttccccttcctgtgtccaagttcatctgttgatggaaacaggttgcttctaaatcttggctattgtgaatagtgctacaataaacatgggtgtgtggatatctctttgatatactgatttcatttttttgggggggtatatacctagcagtgggattggtggattatatggtagttccatttttagtttcttgaggaacctctatattgttctctatagttgttgtactgatttgccttcctaccacaaagtacaagggttcccttttctccacattctcgccagcatttgttattgcctgtctttggataaaagccattttgactggggtgagatgatatctcattgtagttttgatttgcatttctctggtgatcagtgttgttaagcaccttttcatctgcctgtttgccattcgtgtgtctttttttgagaaatttctattcagattttttgcccattttaaaatcagattactggacttttttcctatggagttgtttgagctccttatgtattctggttattaatcccttgccacatggataatttgcaaatatttccttccattctgtaggttgtcaattcactttgttgattgttttctttgcagtgcagatgctttttaatttgatgtgatcttctttgtctatttttgctttggttgcctgtgcttgtggtgtattactcaagcaatatttactctgacaaatatcctagaaagtatccccaatgttctcttttagtattttcattgtttgaggtcttagatttaagtatttaatccattttgatttgatttctgtatatggcaagagataggggtctaatttcattgttctgcatatggatatccagttttcccagcactatttaaagagactaccctttccccaatgtatgttcttagcttgtttgttgaaaattagttcactgtaggtgtatggatttatttctgggttctctattctgttccattagtctatatgtctgtttttatgtatccatgctgtttgggttacaatagctctgtaatatactttgaggtcaagtaatgtgattcctccagtttttttctttttgcccaggttggctttgggtattctgggtcttttgtggtttccctatcaaatttaggattattttttctatttctgtgaagaatgttattggtattatgataggtgttctatcaaatctgtatattgctttgggtagtttggcattttaacaatactgattcttgcaatccatgaacatggaatatctttattttttgttctctctgtaatttcttgcatcaatgttgtatagttttcattgtagataactttaatttctttggttaagtttattcctaggtatttaattttatttgtagctattgtaaatgagattacttttttatttctttttcagattgttttctgttggcatatagaaatgctattgatgtgtgtatgttgattttatgttttccaactttgctcagtttgtttatcagtagtaatagtttttttggtgcagtcttcagacgtttccaaatgtaagattatatcatctgcaagcaaggataatttgatctcttcctttccaaattggttgccatttatttctgtctcttgtctgagtgctctacctagagtttccagtactatgttgaataacagtggagaaagtgggcattcttatcttgtaccagctcttagaggtaaggctttcagttgttccctgtttagtatgatactagctgtgggtctgtcatatatgacttttattgtgttgagatatgtttcttccatacccagttttataagtatttttattatgaagggatattaaattttaacaaatgcattttcaatatcaatggaaataatcatatggtttttgttcctcattctgttaatatgatgttatcgtgttgattgatttgcatatgttgaaccatctttgcatccctggaataaatcccaagtggtcatgatgaatgattgttttaatatgttattgaatgcagtttgctaatatcttttatatatatatgatatatatgatatatatatgatatatatatatgatatatatatatcatatatatatgatatatatgatatatatatgatatatatatatctttgtctggttttgttatcagagtaatacgggcctaatagaagtttggaagtatttcctcctcctcctctaatttttggaatagtttaagtaggattggtattagttcttcattaaatatttggtaaaattcagcggtgaagccgtctggtcttgggcctttctttgctgcgatactttttattacagctttgatctcattacttgttattcgtctattcaggttttggatttcttcatgtttcaatcttggtaggttgtatgtatctaggaatttatccttttcttgtaggtttttcaatttattgacatatatttgctcatattaatctctaattattctttgaatttcttcaatataaattatgacatatctttttcaatctctgatttatttggatcttctctttttgtagttagtttagctaaagttttgttgattttgtttatttttacaaaaaatcaacttcattttgttgattttttgtattttttatttcaattttatttatttctgctatattctttattatttcttttcttctactaattttagattttgtttgttcttgcttttctatttctttaaaatgcatcattaagttgtttatttgaaatttttctacttttttgatgtaggctcttattgctagaaacttttctcttagcactgcttttgctgtacctcatatttttttaacattgttattttgaaaaacttttattttaggtttggggatatatgtgaaggtttgttacatacataaactcatgacacaggggttgttttacagattatttcatcacccaggaattaagtcccatacccaatagttatattttctgttcgtctccctcctgccaccctgcaccctcaagtagacccccgtgcctgttgtttccttctttgtattcataagttctcttcatttagctcccacttatatgtgagaacatgtggtatttggtattctgcttctgcattagtttactgaggacagtagcctccagctccatccatattctcaccaaagacataatctccttcttttttatggctgcatagtattccatggtgtatatgtaccacgttttctttatattgtctatcatcagtgggcagttaggttgattccatgtctttgctattgtgaatagtgctgcaatgaacattcacatgcatgtgtatttatagtagaatgatgtatatttctctgggtggtatatacccggtaatgggattgctggatggaatggaagttctacttttagctctttgaggaatcgccatactgccttccacaatggttgaattaatgtacacttccatcaagagtgtatttgtgttcccttttctctgcaacctcaccagcatatgttattttttggcttttaaataatggccattctgactggtgtgggatggtatctcattgtgggtttgatttgcatttctctaatgatcactgatattgtgcttttttcatatgcttgttggctgcatgtatgtcttcttttgagaagtgtctgttcatgtcctttgcccactttttgatggggttgtttgtttttctcttgtaaatttaaattctttataggtgctggatattagacctttgtcacatgcatagtttgcaaaaatttactcccattctgtaagttgtcttgtttactctgttgaaagtttcttttcctgtgcagacgctcttaagttaattagatcccacttgtcaatttttgctttcgtagcgatttcttttggtgtctgtcatgaaatttttgctttttcctatgtctaggatggtaatgactaggctgtcttccaaggtttttatagtttggggttttatatttacacctttaatccatcttgaattgattttggtatatcgtataaggaaagggtccagcttcagtcttctgcttatggctggccagttatcccagcatcatttattgaatagagagtcttttccccattgcttgtttttgtcagctgtgttgaagatcaggtggtcataaatgtgttgccttatttctggactctctgttctgttctattggtctgtgtgcctgtttttgcatcagtattatgctattttggttattgtagccctgtagtatagtttgaaggtgggcaacatgatgcctccagctttgttctttttgcttaggattgccttggctattcgggctcttttttggttccatatgaattttaaaattcatataaaatttaaatttaaatttatgttcatctaaattttaaatttaaatttatataaaaatttcagccagacatggtggctcatgcctgtaatcccagtactttgggaggctgaggcaggcagatcacctgaggtcaggagttcaagaccagcccagccaacatggtgaaacctcatctctactaaaaaataccacaaaattagccaggcgtggtggcacatgcctgtagtcccagctactcgggaggctgaggcaggagaatcatttgaacctgggaggtggaggttgcagtgagccgagatcacacaactgcactccaaccagtgtgagtgggactccctctcaaaaaaaaaaaaaaaaattccatatgaaattaaaaattttaatatctttcctggattatagggtttccactgagaattctgctgccacatattctaaagcttcattgtatgttatttctttctttctcctgctgcttttaggatccttttttatccttgatctttggtagtttgattgttaaatgtcttgaggtaggcttctttaggctaaatctgcttggcatgctgtaactttctttaattgactattgatatctttctctagattttgaaagctctctgttattatccctttaaataaactttctaccccatttctctctctacttcctttttaaggcaaataactcttggatatgcccctttgagactattttctagatttggtagatgtgcttcattctttttgcttttgttttctctgaccttgtattttgtaatagcctgtcttcaggctcactaattctgtcatctgcttgccctattctgcttttgagagagtctgatgcattcttgaatatgtcagttgaatttttcagccttagaatttcttcttgatttttaaaaatgatttcaatcttttcgttaaatttatctgataggattctgaatttcttctttgtattttcttgaattttgtcaagcttccttaaaacagcaattttgaattctctgtctgaaatgtcacatatctctgtcactctgggattggccactggtgccttatttggtttgttttgtgaggtcatctttcctgaatggtcttgatgcttgaggatattcgtcaatgtctaggcattgaagagttgggtattttttgtagtctttgcagcctaggcttctttgtacccattcttctaggaaaggcttttcatgtattcaaatggaatagagtgctgtgatctaagtttttttgtcactgcaaccttatcagcattaggggacacaccaagcccagtaacactgacttgcagattcacagaggtagtgccttggtggtcttgggtaaaacctgagagaattctctggattaccaggcagagattcctgttttcttctcttactttccctcaaacaaatgaggtcattctcctctgtgctgagctgccttcagctgagggaggtgctaccaccattggaactgctctggttcagacttagagccagcatagcactgggtctctctcaaggcccacagcaaccattgcctggctcccacctatgttcattcaaggcccaagggctcttcattcagcatgtggaaatccagccaggcgtgtgtccttctctttattgatgtgagctcccttcagcccagggagagtccagaaatgccatgcacaagccatggcctggagtcagaaacattaggaatctacttgatgctccattttactgcagttgagctggtagcaaagccacaatacaatgttttttctactcctctctttcctcaagtaggagtctctccctgtgtccaccatagttatcaatgttctgggttacaccagaagccagtactgtatgcgggtctcacccaagtcccatggcaagtactgcctagctatctctgatgtttattcaggacccaagggctctttattcagcagaacttgggttctcaccactgggatggatgactcccctctggctagggctggtataaatgctccctccgtgggttcaggctgaattctgccatgttgctttccactctgacagacagcatcaagttctaatgcgaagtctcacaatcactgtactctttcaaacacatagattcttcataccacgtggctgctgctgggagatgagagaggggtaacgtaggcttcaagactgtctttcctaccctcttcagtacctctttcattaatatgatgtcaaaacaaggtactgtgattactcacctgattttgttttttctggaggtgctttcttgtgtggatagttgttcaatttgatgttcgtgtgggggaaacaaatgttggagggttctatttggtcatcttgttccccctccctaagctcctctgtagattttgaataccaatactcgtgagcttgttacacatcagtaagtaagaggtgtagaagaaaggaaatagcagaaaagacacttgagattctcagtcaggattgcgcttttagaaccaactctctgctctgagcctttatgttgtgagacgataaaaatgtaatatttaaattcatgctaagccgaagtgccagaatattaactaaatgcaggtgatgttatcttcctcccacaatactattattttaactgatcttaaacataaatggaaacacagctccagctagcacatttcctatatttaagccaccccatcatgaaaaaataaataggttcatgtaggaattggtaaagttccacagcttgaggcagaaattactgtttggtagcctatctgatcagttatttagacacattcgtaaacagatcagattattgatccatagaactaattgattcaagaaaacggcatttagtgaaattgaaatatcagaatttatgtcctgtctcagaatcactgggccaaaaaacataacccaggctttagtattaaaagattggagcagcaagaatttgttatgcatccactctgtgcctgaggctctgctgagcactgtagacacaggcagagtcatatactacagacagaatgttaagggtttataatccaggggatttaagttaaataccccagaatctatttcactctaaaactgaatgctaacatgcccttagtgcttttttcatgtaactcagaatgatccttgtccttaacttgggtaagtccgaagtttgacattcaggctactggtattttctcatcacttgacaatacataaagaagttaaacaaagagagtaatcagttttctgctttttgtttctcaaagttcaattttcattgccctctatagctgaagatatacagttttctaagttgtgagaaacaaatcctgtttatctatgattttccttaattcaaatacatctgtgtttagttgaaaaaaatgtgtatatgtgtgtgtgtgttttgtcttgctcttttacttatcccttcttcttgtccccagccctctgcaccagacttatttgaaaacatttttcctgggggaaaaatatgtctttagaaaagtacaaaatgcccaaaggtaggatacatttaatatgaaagaaataattattagctaacttaaatacctaatttccaagttggcttactatattggcccacatagaaagagacacctcttctgattaaagcaagcaagaccatttggtactatcttcttggcttctaatcatcctctttatagagtgatactactgacagtgggatattatacatatgaagtgtattagtcaggttctctagagggacagaactaataggatacatgtatatatgaaagggagtttattaaggagaattgactcacatgatcacaaggtaaagtcccacgataggccatctgcaagtcgaggagcaaggaattcagtggtgaatcagcgcgagtaccaaaacctcaaaagtaaggaagcctacagtgcagtcttcagtctgtggcccaagagcccctgggaaaccactggtgtaagttcaagagtcccaaagctgaaggacttggagtctaatgttcaagggcaggaagcatccagcttgggagacagatgaagaccagaagactcagcaagtctgctcttccatcttctcctgcttgctttattctagccttgtgggcagctgattagattgtgctcacccagcttgagggagggtctgtctccctctgtccactgactcaaatgttaatctcctttggcaacaccctcaaagacatatccaggaacaatactttgcatctttcaatccaatcaagttgacactcaaccttaaccatcacatgaagtatgtttgtaaataaaaatgaactctgtatcatgataatccaaggtgaaatggacatttacttttctggcaagtctgggtgttttctgcttggaaagcaatggcactaggttgcatatacagcctctaacaagcaagctcctgaaatatgatttctcattgagcaaaatggttattccacacataactgcagtttcagcagtgcctttttgtttctggttattaatttctatttaagttgtgccaaagtcattaatttactgagccaacatggaaaatgtaaggcagttaactttataaatgacaccatcatgcttcagtatatttgtgcttaatgccattataccacgtgaaagattctaatttccttatacttgatgtaactggtggtattagaatgctaagactgtggtagtgtttgttgctttaattgtactgaactgactagatacaagtagcccgttaagtcctcattgtccaatctgaaaactacattattgttaatttttttcttttggaagcatcaagctttctcaatattgtgacacttacattactgttgaagtctttaaggagagaataaatatgctaataacattctagaagcaactaactctaagcaaaagtgaatagtacagcactatcaaggtgtacacttttttccctggaaaattatctccatcaggtaatgggaaagcactgctctacagaaaagcaaaaaatgacttataagcttgattcattgttactttaaaacccttcatatctgaaggttaagctaacattaaggcagtgtacaactatcagaacaatatttcatatatttgtatttagatgaatcaccagatttgttagtctctgaatattttctatattgagccagattttagctgccatttttgtgttttaataaggttttcagttgttatccaaatatgacccagtacctgaatcaaaacagcaagctttgaggaataggtcagtatttttggataaactaacaaaaaaaatgttcatcaggctaagacatcagcagtatttgtggtagaattaatgagtattgttagtgtatattttaactgttaatagtcaatgctctattttttctatgaaaattcaacttcctagtcgactctttgcactccttcattcacttattattttacggatttccctcttgtgtcagatctctagaaattctcacttttcatctggttttacaatcattttctatttttctcagctctagaaaagtctctaaacaactccagggcagaggatccatttgtttaacagtggcttcttgatcaataattgcatgcatgaaacaaagtatcagaaatagtttgctctttacactatcaattggctgatatttaaacaaattgtctttaaagtcactgccgcaattttgtttggcaatggcattttatttaattcatttattaaatgagtttccaaaaattaagacctgaataatttatgacttcttctaatctcaacagaaataagtcaatgctggctgggtgcagtgactcacatctttagtcccaggtacttaggagggtaaggctagatgatcgcttgagcccaggagttgaagactgcagtgaactctgattactatttcactccagcctgggcaacggaaggagaccccgtctcaaaaaaataaaaataaaaagtaaaagaaaagagaaagaaataaaacaatgttaatctgtgtcttggcacgaagtttcacacttccatcaaatgggcatcattttgtgctgctaatgtctcttagggcgattttaaaacaaactaaaaatatgaaacactggatagtgttagccttacctagcttgattttctttgggtgtacatgaatgcaaataaattctacaatttcttaaattcatatatatgtatatatgcacatacatatattcatatatatgtttatgtgtgtgtatatacatgtataggtatggtgagtacatatggggaaccagttgaaggatgtttcttcttttacaagaaaggagagaaaacaatcttcccgaaaagtggtatttactagcatgaaaaaggattgagcttcatataggtagacattactgtatttctatcatagggttatgtgtgtacataatccaatctgtgtttataattcacatacctactctccattattttgatgattcaggaaagtaatttctcaaaatttttccttttgcaaatgtgctttttagataactcactggacctaaacacttggcaggcattagggtcgaccttccctgctgggttgaagaggctctttcatcccccagacctgcagactgaaagtcagccaaagtgctagagattctggcccttatgtacctgctgcctatggacttgagttttacagaaagaaagcattacttggcaaaaacctgctgatcatgtctttccccttggaacctcacagcacaaggcccaggcttactttttgattcagtgatggtgaattgatggactattatagaacttttcacttctgtgaagcagcattgtagtatcagcaccctgcatttctcttaaaataaaaaaaaaatcacagtgattctaggttttaaaaagttgtattattctgccaaaccatcataaaatgctgaatctttctagtcaattttattgcaaataactactgctaaaataaagtagaattaggtaagtaacttttttgataagcatttacattcttaagatgtgctactgttcagtatgtgtgaactcctaagttgccagtacagtgggtgctattgctatactaacgcatttcacctgtcctttacctcctcttccagaggtgcatactacgtgaagttttccaattgctgctgctttatttgcatttagtcacccagccaaaggttctcacattttatgatgctttataaaaagcttcaagagcatattttaaaagcaccctgtcagaccccatgaatacacactctgaatcaattgttacagattgaggccaacaaatattcattttttcaagctttcctggtagctcttactaattcatccaagaacatcttgttgaggaatacacaaaagattttgactgcaggattaacctatttataccaaagctttgtattcctggaatggagcagttgcaaatgctgatgactattgcattaattgatgctttgagatgtagcagtactcaacctgttctctaacatctgacactctgtgggaaaacaaaccaacaaacaaacagcaagaaggagtggttgaaatagcaaatagtcaacctggacagtatctggcctcccaagggaggcagaagtagtcctgagggatcctggggtcaaaatgtggttgtgaaacccagagaggggataagggctgggtgttcagtaggaacagtgggaacacgtgcttctggttgctgtttccttttcacttatcagtttacacgtttctaagcttagagtggggtatcgagaagcagggtctcattgggcatgtattatgctgagctcagctgacttcaggaaacatagcaaagcattataaactgtaaggaagaagacagttacgatagaaaattttatgacaacgtaatgtatctctcatggaagagctgggggatgtcctagtataagaggttctagagtcagcaataagatgtgagagtcctctctctctctctcgctctttttttttttttttttttgagacagagcaagactctatctatctccaggctggaatgcagtggtgcaatcatggctcactgcagcctcaaccttctcccacctcagcctcccaagtagctgagactatgggtgtgtgccaccacacctggctaagtttttttttttttttttttggtttctggtagagacagagtctcactatatttcccaggctgatctggaactcctgggctcaagcgatcctcctgccttggcctctgaaagtgctgggattacagacctgagccactgtgcccagccaagattttcttttttaataacacaaagaccaagaggctccccaaacagaaaagtgatgaatgatatgaacttagtgctaggttccagttcaagaatgcagactgatgctgaaatgatggcacagattgaaaggccaaggacagtttctggcatcaaagcctagggcaaggagttcaggaggcagggggcggagactaaatgcacataagttgaggataataagatgacacagggcagtcactcagaattcagtataccactaatgtgcatgttttgaatgcctcaagtcaggccaaaactattagccttattgagcatgattaggtgtgctgcttttcagacagttactgcaattacatactgtgcagttcagttcagtggttggtatagttaagcaagggggtgcctgtattgaaagattgtggactaggtttgcctgtatttcttgtttaaaagttgattctactgttacatttgttctaaacagttgcatcagtttatattagcagttgatcatctcttgcccattgaaatcaatgtgatttagaagcaagatatagaatctggagttaggtagtcctggggccttcatttaccacccttagtttattgtctgtataaatgtgataaattatgtttaccttataagtgttaaatgagtgagcatgtgtggatatgtggctgggcgcagtggcttacgcctgttatcccagcactttgagagtctcaggcaggcagattgtttcagcccaagaattcgagattggcctgggcaacatggcaaaatcctgtttctataaaaagtacaaaaattagcagggcatggtggtgcacacccgtagtcccagttactcaagagtctgaggtaggagaatcgctggagcctgggaggtcaaggctgcagtgagctgtgattgtgctactgcattccagcctgggcatcagagtgagactttgtcttaaaaaaaaaaaaaagaaaagaaaaaaaaaagaaaaaaaagaaagggcatttacttggaagcattcttggtattcagtaaatattcactgctttctccctttactatttaatattctctggcttcataaaatttgactcttatgacttctgtgctcttattcacgtgaggcttctatttaattatcttgtcaactactatgtggttgatttaaggtatgtgaaacaagcattcatctgttccacatcatgtttctccctgggaccacatctatcttatattaagtgatctttgaagcagctctaataggaattggtcccttgggacaggaaaacacctgctcctgctctctcttgtgctcgcacgtcccaggagtcctgacctgtgtattatcataggcaacaccacccaggacacctggccatcttccattcatggcctcccctttggtgaagaatgtcctcaatatttgtggcaattagcagctattcttgggtaacctttagttaaaagagagtagtctcatgggctaaagactaaaaagaagacgtgtaataaaattccagagaaacaagtcaactctgtcagtgtttatgtgaaaagagatctgggagatcagtgctcagccttccccaacagatgcacaatgttttgtagcagggaattggaaaacaaactttgacttgggattcattgtgtgactcttcattccaccaccaacaatctgtgtgacttcaagcaaaacagctactcctgaacttctgtttcctcctgtataaaaaggggatactgaagcatctaatggtttgttggaaggaatgaactgaagatcagttgtaatgctctaagacaaagctggcttatgataaatgctagtctcattctccttgttgtcttttgagaattgccctttgtttcttttatgaaaataacatttccatctttcccatcccactttttcttttaaaactgcttccctgtacacatggggcagccacccaatagctcctgaagggatatacatgtatctctttaaaggggatgcagctgtctgcattgtttgcattgcttgcacagtggtgggcactggtgtcataacccattgccatagctaagcctttctctttggtatggctggctgtgtgcatgcactagaactcggtatggtgtatttccccagagctcagtcaacaaggaattgctaaaatgaaatgccatttctgctgactgtaaatggaagaccctattttctttcataaatgtgtgaaaattcaaataattaccctactatttgatgtccaagttggtaaagatcaactagcagtaagtcccagcatttagttataacatatttgacttttgctttgagcccaagaatcttcaacatacttggctgtaaaatgggaatatcaaagctcatgtgttctcacatgatttttatggaaagcaaatgtataatgtacctgacaaggagacataggtatttgtgtgatggcctcaacatcatattaaaaccaccagtgattttcttattgatatgttaatctcttatcacatgggaacttttttctttgatggtcagtttgctttcatcttgaaagaaatcaattgttgatgtacgctgtgtgttaattgcttcgttaatactgctctggtacaataaccaactgtagctgaaataatttggcatgttcagtactgttcacgttggatagtaagtattgtgtggttaaaatgaagatatctatggcaaacttgcaacaatcccaaaacattgcttttctggttatatatccagaggcagttttttttttcccatattcattagtggtcatcgctctccacaggccattgcaatagataagtaggtagtaaccagggtaaagaattaggttgcctagaaggtcagtgaaccatacagaacttgcatatgactagctgatgcctagttgttgaggtgaacattgtgataaaatcatatttgctgggagtggctgacagaaaatattttgtgagtgagttaaacacctcacatcttgacataaggcatgtatcaagctgtttatgacagcatctgattcagaaaaagtacttttttcagtattaaccatccaatgcaaatatttaaagcctgcttttgtttctatcaaagagaatgttgggacagagattgtaaaagagaatagagcctgcatattttcagatcctactgaaatacagctaaacttagattgtttatagagaattgcacatttcaatattttagtatttgtcttactccaaatgtcgtttgggttgtctgggattttatccttggaatatattgcaagtgatctctgtgttattcgcctcagctcctgaattctgatttatcgtctctagtaagcaagccagtgagcatcacacaggagattctcagggctcagtcattcaagaagtgtggactgttgaaatttaggctttgtgtacaatctgggtaacaaaccgtaaaggcatgttttcttcctaaagctctatggaaaagtcatttgccatattacttcccccaacagcgtgcaccctgatgtggagagatgcagagtgtggtccaataataatattgaccatatgcttttctaaggcaagcagacatacagtagatactttaattttggtcgttggggtatggaaggaggtgggaagtggagaaaggagagtaacccattacctgtctggcctaagcttgttatgatctgacagatgggtagccccagggctgcttgcaaaaactatttctttttgtctccatcacagagccctggggtgtggtacagggagggttgaccaagagaggggaggcttccctgatggagtgtgaggtctggcagcaggacctgacaaaagtgagtagactgtctgggtccagccagctataaaaggaaagaacagaataacagctacagctcggtgggagttctagtacctggattttcacccaggtggatgccaggcctgattgtctatctcctgaggaatttccagactttgtcagagttcttcaggaactgaccagatccagtttgcaggttgggggtcatcactatttccattgggtcaaattggagtaagcagataccaagagtcacttacaaatcactaacatctattagatactgaccattctctcattttctcacatcaaccatgtgagataggtattattattgttcctgttttatagatgcagaatctgtgatttgtctggaaccacagctataagtggtgcagcttggatttgatctcacatttgattttccctgtgatccctgggatctggcttaggtttggatatgcctctgaacaaatggtaaacaagggaacctaaatgtccataggtgtctatttacctggttgtccttagttcagcatctttaaaatacaaaaatagatttgttgagaatactcatttccattattttaatgagaataacaactcagctaacttttaacatgaatatacactaaaaccaaaagtattatgctgatggcaatctctacttccttcttattaaagcttatgagccatggaggaccctgcccagcctgagctgcccaatgtgcctgcgttagccagcctcagtgtgtccctttgtaaagcgccccagaccttttgagtagggatgaccacttcttaattcatggtatttatcagtaatcatgcatatgcaaaattttcaacttctgcttagagcctttactaatttatttctgtgaatgctctgattccttccaaatgactctgtaagatgatggttgcaggcttcattagttcaaccttcagaatcactcaatgttacagtcccagttttctctctcttttacccaaataggctttacctatattaatgattgttgctgggctcttcgacaagatatttcaagaatgggaaaagcgttttaaaagaagtttcatgaggctttggaattcacaagctgtgagcagcactggcagatatttttccagggtgttcatttttattcatttccttatagcttttatggctaaccgttctaagacatatacagtgctgtgttgtgatcaaattttctcctctgatagaagtcaaactttgaaaacttagattcctagaattgttgaacattctaatcaaaaacttctttgagtcaatccagtttaaaatatcactgattgcgggggggtggctcacacttgcaatcccagcactttgggaggccgaggtgggaggactgcttgagcccaggagttcaagaccagcctgggcaacatagcaagaccccatttctaaaacaaacaagcaaataataataaaatatcactcatattttagttctttctaacccatggttgatactctcaaccacagagtgaggaacttactttctgcctaccatttaatctttgatctctaaaggtttggaccaaatggcttttttgccgtaagcttaaatatcttgtcttatttttttttcctacctatttgtccaggttgttttctttgcatttaggacagtggttctccatacgtgtgcatcaaaatcacctggagtataaaatacagattcctggggctggctgtggaatctctgatttggcagggtttagggagaggcctgaaactgcatttttaacatgttcctgggtcgtattgatgatactgattctcaccttgggaatcactgacctaggaaatgtcttctcttcatccaaagaaacccttacaatccccaaagatgcctttttttctcctggctgaacaaccccaatttctatgactttcctttttagacttcagcttctccaccatctcaccatccacacttcttgcttgcctgtcctgcttgcctatcactcactgaatttcagggagccaaactggcaatataaatgagtgaaccaccacaggtgggggtgagatgagtcagatagggaagacagcagagactgtctacccggaatcaactgaggaatgcagacctcacccaaacaattcacattcctgtttttttgtttttgtttttgtttttgttttttttttaagcatcaagcctacctaataaaatatgaattataaaaaataattcagttgcctagatttgaccccaatgaatgatagtttgaggtcttaaaatataattaaaatgcagcttgaacctgaaagtggcagactatcaagttattatccccagttgtttgggtttctattacatgaatccagttataaaaataacacttaatacattataaattcctaattagggagctacccagtaactgattatattgacaaagtcatgccataaataagaattaaaaagttaatataattgattagctaggatgccctcactcttgtttttgccattatttaaaatttaattgctttgcaacatttccagatgttgattttggacattttttcatgtgttttattgcctgtgagcagtttttatgtacttgtaatcggagcttttcacgtttcttggatgtagaaaaatcaattaaaatgaagcaaatatttttgaaacctaaccagacttttgtctttgttttctcataaagttcctccatagaaatgtgtggcatgggaacagagcctaatactttctgaataagatattaacaggcttgtagtggatgctgggaatttagaaagctctgttttttttttttttctaaagcctcccagtagaatgtcagactaataaatggactgcatatttccacagtgtttttatgacatgtttcacacactgtcttggtgcagatatgagaaagcccttgtccacagcccagttctgactcactcattaattttaccttgtattcagttttcttggggtggatctagactagaatagaatagaataagccgacctttaactacagtccttaaatgaggaaatctccaccctgggccagctgtgccaggaatcccgacgagatggaactccgctgtggtttataggcagggctgattttcaggggggagtgcacccatctggactccctgctgttcccatcaatctattccagccctggtacccctggaccaccctactgtccagcaactaaaggattaacaggagccacctccaggagcctccgggacccttcagaaggtgtctgatttgatggatcagaggctaggccactgccagctctctgcacatattttacatatcacccatttgcaggtgttgaagaccggtaagtgcccaggagctggcaggtgttgcaaacatgtcagtgtacctggtgggggcgctcctgcccagctgataggagacagcttctacccagcccacccctttggtggctacaccagcttggcacagtctctcattgctgaagagcatccccccgccaactccgcccaatccccacctccagtcttgactacttttcattggtttgtttgtttaaattgacatctcctgattttcaaaaccttgctgattaacaaagcaaaaagagcacacacaaaaaaaaaaaaaaaaaaaaaaaagtcaaaaacaaagcaaaaaactctcagtctaaaacagataaacaaaccaacaaacaaagcccaggggctgctagaggttgactcttgtaaactgcaagaacggacaccacaaactccagagcagagggcgcctggacattccagtgacttcatcaagcagtaaaatatccgtctttcatctgcttctgctgatgaccaatactatgcctgtcacaatttccagtcttttagagctactctttgattacacacaaccgagactttttctaagcctaggacattttctgtgtccttttaaacattgtttacatcaaaataatgatatggataggtaaaagaaaaatacaaaactacttgtgctgtaaagtagttctattttagaaaaggaaatcttgacaaaacttgagccttgttaggaaaaaagaaaaatgacaaagcagtcatgtacagaaagcctggataggattttcaatctccttgtgcaaaatctggcaaaaatgtatgctaagggtccaaagcaggaagtgctcagaaagcaaatacagaaactcagcttagcaaaggggcgaagccagagagggatataaaggaacagaggaacggctgaggatagaggtgaggaagctggactcacacagactgggtcttgctcagccttctgcagtaccagtgtcagggccaggcacacaggagtgactaggagtttgaactgaaataatgcatgactaagaattaatttgggatggtcttcaggtggaatgattggaaatgttgttttacttttaatttttcagtacatgaaagaaaagatgcctgttttctaatcattgaaatcttattatgtacagaaattttcctagcagagcacacgaggatgaaaaagaatcagatgggagatgaggatcaggactctttctgtgaatcggaacctctctgctctgctccttttctggtttcctctgtctgtccttctcttgtctccattattcatcctgtttctgccttgatgtcatcttgttggatgtcccatctcacttagtcgtctgtaatttgtaagtagcatttaaattatttgtggtctttatctaataaagctttattctctctggtcttgatgaatgaagaaggcaaactgagccttgttttttcccttattgtcttacttccccaaagcacctgaatgagttctgtgtggtctttattgacctgtgatgatcactgtcccataaaaaaagcatggtagcgtagtgcttcagcataggctctgctcagaagacttggatcccaatccttactcacttgtcgagggagtttgaacaaataagtgaatttctattgacctcactctttcacatatgtataaggggaattgtaatagtacatgtttttttaggtcattaagaggattaaatagatagaatataaaatacgttagcataagtgcctgggacagggagaatactcagctaagttggaaatcaggtgttggcaaactttttctgtaaaaggcaagaaactaaatattttaggctttgtgagtcaaagtctctgtcttaactccttaactctgccattgtaccgtgaaagcagccacagacatatgtaaatgagtgagtgtgggtctgttccagttaaaccgtatttacaaaaagggacagcaaataagatttggctcatgtctctcagtttggcgatcctattgtagaatatagttttgacatactggaaacagcttctctgtaagttaggatctgctttgttgctaactaatttaatgtgaaatttaattgacctatccatatgctacatctgacaaatagtttggcacacaatttgcttagcctttgtatctcgaggaccagagaagttaagtacgtttggccaaaagtcacccagcaaattgatgacagatctggggcagagttcagggctcgtgttctcagttctgaactatttctttttttttgaaatgtgtgttatcggggacgtagctctgtgatatcaagagactgggactgaagatctagttttgccagttgcggaacctcagatttgtaccactcactatatttggacctcagctccctcattgtcaaatagataataattcccatctcacaattttacagtgtgaaaacaagaaaatgccatatatggaaaatgccatatatttgaaatctctattgctgtggttggccagcttccttcctgccttccttcttctccttctccttcttcttcccccaccctcccctctctctctctttttctttctctttctctttttctttctttctttcttttctttctttttcttttctttctttttcttccttttctttcttctttctcctttttcttttattacttaattaacaaataataattgcatgtattaatggggtacaatgtgatactttgatacacacacgcgcacacacacattgtagaaagattaaaccaatttagttaacatttatcaccttatctacttataattattttggggatgagaacttttaaaatctactcttttagcaattttagctatgtaatatatttttatcagctatggtcaccatgctatgttacaacttattcctactgtttagctgaaactttttaccttttggtcaacattgcacctttccccattctccctatcaacctctgataaacaccactgtactctctgcttctatgagtttgacttttttagattctacatgtaagtgaaatcatacagtatttgtctctgtacttagtttattttacttaacataatgtctttcagtttcatccatgttgtcacaaatgacagaatttcttttttgtgtaaggctatatagtattccattgtgtgtgtgtgtgtgtgtgtgtgtgtgtgttttctttatcctttgatcatttggtgggcaattacattgcttttataccttggctaatgtgtataatgctgaaatgaattatgagtgcaggtatctctttgacttacttattttaattcctttgggcatatactccgtagatggattgctggatcatatgataattctgtgtaatttggggcgggggaaccactacactgttttccatagtggctacactaatttacatttctatcaacagtgtacaagggttcccttttctctgcctccttgccatcacttattatctttcgtacttttgatattagctatcctacaggtatgaggtaatatctcatgttggttttaatttgtatttccctgacaattagagatggtgaacttttttttcatatatctgttggccatttgtatgtcttcttttaataaatatctattcaggatctttattcactttttgatttggttatttcttttttttaacattcagttgtttgagttccttatatatgatggatattagccccttatcagatgtatggtttgcctatattttctcccaatcaggagggtgtctcttcactcacttcgttcttaattgttttctttgctatgcaaaaagtttttagtttggtgcaatcccatttgtctgtttttgcttttgttgcctatgcttttggggtcctatccaagaaatcgttgcccacaccaatgttgtgaagctttttctctacattttcttctagtcattttaaatttcaggccttatatttaagtctttaattcactttgagttgatttttgtgtatggtataagacaagggtacaatttcattcctctgcatatggatatccagttttgtcagcaccatttattgaagagactgtgctttccccattgtatattcttggcacctttgtcaaaaatcaattgactataaatgtgtgggtttatttcagggctctctgttctgttccattggattatatttctctttttatgccagtaccatgatgtgtgtgctattatagctttgtaatatattttgaaatcaggagtgtaatgctgttttgctttttttgctcaagattgctttggctatttggggttttttttttgtttcatataaattttagaattgttttgtctatttctgtgaaaaatgccattggaattttgatagagattgcattgaatctgtagattgctttgggtagtttggacatgtaaatgatattaattcttctaatccataagcacgggatttctttctgtttgtacatgttgcctttaatttattttatcaattttttttggttttcacttcctcaattaaatttattcataagttttctttttgaaatactattgtaaattggattgctttcttaatttcttgtttgtatagtttattgttagtgttataggaaatgtactgatttttgtatgttgattttgtaacctacaactttattgaattcttttatccattctaacaactttaggtgaacactttagggtttcttctatataagatcatcagcaaacggagacaatttcacttctcttttttatttcaatgctttttattgtctataaatttattgactgctctttaatctttcacctactttgtaagataaatttagtgaaacaggttagacagcatggaggactctgatacaaaacgattttataaaaacacacagatataaatgttttctgattaatggccattagctagtttcccaatcagagcacgttttcacctgtgctctttaaattgctttcaatgtagagttacaaaatggaaacttaagggtcagaaaaggtcaaattacattaatgacagtcctcatgatagtgttgatttaatcaggatgcctacctttgttcatttaccttttaaaaataagtataatatattgcagatcactaatactgctgttagagaaggtggttattgtattaatgggatatcagtaaccttctctctactgtgacatggattactgtaattatgaaagagacataaggaaacaccataagcactatccattgggccccaggcttcattagttctcatatggctgtgtaaaaatgctaattacaaacatatcgtaataaaaagggtatggcttaatgccaacatgtacctgctaatttgatatttatgatggtagagtgaagcacatataatcaaaagcaaagagacttcagtagagcagcattctgtattttgctgactgaagaaggctgtgagattatccagccatttatttaattaaaataatattgactggtgaccatgttattttatttagtagatgtgtaagcatattcatttaattttcaatatttatatttcatgtgattataaaaatgataaaagctcaatacataacaggtagtatggacatgtacagaaaacaaaggtagcagaatcctctaaactttagctgcttcctggtctacatttatatgcacctttctcactagaaaacatatcgattattttctgaattgtaattgttcaatttaaaaataattttaaataaggaaatgttggggaactgatatagctcagtgttgaggcagagatgttcctctgttcatatgttttggccatttttatgtgaagctgtagagaacagtgactagggtacttgtgctaacattgtcctccttattaaattggacatacatcatattttagggcaaaatttcactttctgatttctcagaaagcaaaagcgatatcaaaaagtatatcaatctacacttacatagattgattataacattttcatttattttttttttcacaaacactcattgtgttctgtctgtctttggaatgagatatacctgaatttcagtctcagctttgctccttaacaactggaaggtatgtccatgtaacatgatcccccaggcctcaacttcctcatccaaaatctatagattaaaatttgtcttctcaggtattgtgagccttttgtgagatcatctttatgaagttcctggcaagaacaggtactctgaaactgttagccagcataatgtcaatatcacctcctattattagtgccatggtattttgtgaagtgtcttattaacataaatatacatgggtaaacattttcacaaggatgtctgtaaaaaaaagaaatttctagtgaatttccagaattggaaaattgtggaatttatccttcatcagattttagctccaatggtgtctacctgccagagtgctttgaaggaagatccatggagtttaagataaagttagcttgttttacagtacctgttacttttataggtttttttacattttaatagctattaataatataggtatgattatcagcatgaagctcccatacaaataagtttatgttgaaagtgtcaatcgtcattaatatcccataagaagaaactatttaaaacttcataggagttcatacatggggttcccatggcaacaatggagcttataatttttaatttattgcttaattttctctaaactacattgtcattgcatcggcaggaatcccagtctgtagtaatgatggggattaaatggtcattatgaagttgttcaacattcttgtgatttgcttcagggaacattggctttgggtatctttgaatgtactattaagcattgttaaatccatttaaaatagactgagtttacagggaaatgaagtatattttcttattgcaatttatcatccagtaataatggtaaatattgcaagtcaaaatttaaggccaaatgtaactcaacagtgagctgactaatggctgtcttgtgcttaaagaaagtatattgcttttgcatttaaccaaatggtcattgaaaagtataaaaagatatttaatagctacaagtcatattccagaaggattcaatctgtaatataaaatgagccaaaggaatcggttgctgtcttgttaaagaagataatcattacctgagattttatttttcttataagtatctcctcctatgtcaaggtcaaactgatagcaggttagaggtttgtgtctatggacatctattttgcaaaatacagctattcataaactaatcctgaaatcatttaaaatattgcaggatcaattcaacatacctatacagtgtcaattcagggaggtcaggaaagtctgtaagggagaaatggaatattagctgggaagcatggggagaatccaaacagaagggaggcagggaataggcagaagaatgacagacatgaataccattggcagaatgtttgtggtgttattgtaagttaaaatgttaagggagaaggaggcatagaaatttgctttccaggtgggaaatttgatcaagagtctatcttttaggaaacagacaagatggaatatagatcttccagcttgtagtatgtttcaagtgttttaagaatacaacccaaacattatcaagtgatgttttaggcaaaggagaaagtaatgtgcatgatactgaatgttcctgtgagcatcaaggaacgtgattagcatcgggagccctgtgaaattgtctaggtcactcacatacctttgtgttcctttaggattattacaaaaaacactcctatcaaggtagtttagaaaacatgatctccatttaatagaaaggggatattttgtttttctagagtggtaactgaaccttgataaggaaaatatgcagaaatgagtgaaaaatggggccaagttgttgactacattgaataaaatgttagtcaacatcaaagtccttttatgaaggaaactgaattaacatgtcatttattcattgttacaaataattttcagttaaacaagtgaatattttctccaaaatggctctaaatttaattgtcatctaaatgtttgaatattttggcttttttagtctcctgtgaacatgtctgttggtctatggtgtctcacggtgtatgtgctcctgtgagcatgtctgtgtgtatgtctatgtctgtgtctccgtatgtgttgtatttgaaagtctaaaataggaggccctttaagagaagtgtttatgatgttaaaatctcaagtcttttcatggaagtgtgtctgcgcaggtaaattggatgtatatttctctctgaatgatctgactgttgggtttaataaggctatagctgatgccagttgtgttgaggagtttgcaaatttattgtcaaataaactctcctcttacactgttttgagatcattcctttgggcttatgtactttttcttcacatgtaagtaaaatgccacaaatgcttactcttgaaatcctgagagaagtggcatattatttttatgggaattgtacgattcttaaccactgtccttgattaaaataagagccttttttccttcttaaacctgatcattttcacactggaaatgaaatctttcatggggattagtttactcactcaagctttccattcagatgaaggtgtgaaaaatacatgacaagaatattatttaaatgctcaaacttctgcatgaagagcatgaaacaagaagaaaatgatagtctttagctgtagataggtttcaattttttttagtaggcttcaaattccttttaagacaaacaaaaaattaaaatagaagaccaactatgaaaataatgatttgatttaatctaaacttccatgaaggctgcaagttacagattaggtgcatcacctgaaagtaacattgctgattgcatagctttggaagctaggttcaatgatgtatatgcaagtaactaagtttcatatgcaatggttctctattgcactcaggaaattagcctggcatttaaagccattcatcatccaacctcctgaccactccaacactatcttccttcactctctcagcactccaaatatctctaactgcttgcagtttcctgaatatattactggttttcaagtctctaaaaatgttgctttccctgtctgtcatgttccttttctgttgttccatctattggactcatcctttaggatttcattccggaatcagtttccttctccaacatcttcctttgggttacctgggtggctaacgccctctgttctctcatagtaccctgggttcactccagtcatagttctttatacagaatattttaagcatgtttatttttctgcttctcttattaagtagagagaatctaagaaatagaaaccatgccttcgttagttttttagtcccatagcatcaggcttcatccctggaacatagtaggtgctcagtcaactttgttgagatagactttgtgagatgcagcagaatcaaggaaggtaaatgtcctgggttctatacagagggagttaaaaatacaaataagaagaagtcactcttctaaaggaacttgaaaaggaaaagatgcataattatcttaaatataaagctatgtgtggatgctgtcagatgttcacctggaaagagtcctggaatgaatggagcaaaaaattcaaatttcttttcactgagaggtggtggaaagccttcatgaataaagaaacatcttgagctgagcctcaaggatcctataagagttgtttattgtttgtttgtttgttttagtggatatttactgagctcacatagcctgtaagaatttaagctctgtattaccactatggttgacaagtgtgaatttaattagcccttttcaaaaaaataataaaaagcaatccattttacctacctaaacacaatagaatcatctaaatatcttattttcagtggttttctgatagaagataatgcacttattctgaagtcctgtcccctagcaacactcttcttcaccagtctgctaatggcttggcagaagaggtaaactcagttttggggcaaaagttttttaagcaggaaatcatgcaaaagtataaacagcaaacagattttaaattctgaaggttcctgggaaaagtcataggatactgaatgctttgtcatggctatacagatgaaaacatcgctaaacagagtgaatcataataatggattttgtaaggaatttctttttttttgttttgttttgttttgtttttgagacagagtcttgctctgttgcccaggctagagtgcagtggtgcaatggaatttttaaggcatagttctctgtttgcttttaacccaagcaagaagaagaaataggactgtaagagagacaagaaccctatcaatttgaataactcagggaatagcaaagtatttgactttgaatgcaggatttctctaaaacattgaatattgaagagaatattttaaggataaagaccaacattcagttagttcttgctcagtaaatgtggtagtagggaaacaagttcagcatgtgatctaagtactggcacatgaatgaacagcaaggctcataaacagccaatgagaaaatgaagctcactgttaatatgggaaatataaactagaataaaattatattggaaaaattttaaaaatatgtacaatacctggagccctgggggtatggaaaatgtgtactataatacactgttagcgaggttagacgttggtgaagtctttctgtcttgagacaaagtgaattggcatgctatttcctgagagaggaagactgggaaagaacaaggtatagggaagtattaaaaaactaagaattctatttgggaaattttaaaagattattatcaagaattcaggtggggatgtcaaataagccattgagcctggagccccaggaagtggttagtgctggaagaattggagtcaccggcatagagaaagtacatgaagttatgggactttagttatcaatcactagtttcataactagaggttggttaatggtctgctattgcagggtgcactgttctcagaatttgtgtggatatgataacacaagtcctgagttccaactttaaggagcatgaaatcttgttttaaatacagaagcaccgactatggggcaagtggtccattaaatatataaagcaatcacttcccctttttttgtacctttagtaggccagcactttgcatacattggctataatcttcacatagacatgccgaggtagatattttttccccagttttactgataagaaatctcaggctctgaaaggataagtgaattttatattaatacattcactggatagtaaatggagttgctggatttccagtcctggtctatctcattgaaagcctgttctcttttcaactgcctttcagtaacaggtgctgttgtcactgaatccttagcttcctgacccatactatctgaataatgatccctacatacttctaggaaagaaagatatcaactgcaattacccctatttgacagatggagatcctggattgctctaagtttaagcaaagcaattaagcttggccaaggtgtctgccatgggaaagcagattcactccattgcttcttagattcaaatactgcaatgtattgattattgcatgaatatattcagtggcttgatataacaaagtggcccatcactcttgatcattctcaatatcagtgtgcccaaaccctcaaatgacttgccggaagcttatatattaagggaaacttccagaatgcaatggaaaatgaaactttgtttcactagaatagattctgttcttgaagagagaataggacaatagatttggttttcatggatcaattctcattcttcaaaacttctgcaattatctgtcgaatttaaatttagctcaagtgaacactagtttccaggatgggttcaggagctcaaacttgatagctaaaggagaggtgaatggctaaaatacctccattcttgtgagcttaaatttatacataaaagtgtcaaatcactccacaaaatcactgagctttcctttttattttactttttacatttaattgctgggcagttgaacattacagggcaggctactgcatcagtactaggtgccttgctctgccatcattttgtcagttgttctgtgtgtcaaatatattattctgtttgcaaaagtcagccactgacttttaacattgtcatcatctcattctattccccactcctttttgggcagagtaaatctttctaaagacaagggcaagagaagtcactaagttattggctgccctttttcactgaacccaaagagaatacattgaagtgtcaagtgagtgagcttccaccgcttctcagcctatcatcattactggcagagaaaccagtaagtcaacccaagacagcaacggagatatgtaactatgggatgtgttgctttcaagagaattgcaactcagagctctttctagcacgtggaatcaatttaacccttttatacataagccaaagtcctcccttcatgactcagttatttgagttaataaagctctccaaatctgtctagtcctttagctaaacagtgttaactaaaccatgtgaatctcctcctctaattaacagctactttattaaaatgctattgccctgttgggaactagttggcagggtgacagagaatggagtttgtgctatggactattgattttcagttaaattcttactgtgctcttggctttctcctgcttgtggcttaaagtacccaaaccattcaggccagcaaaagaggccactttgctctccctggtttttattggcctcttttcagaaggtctaattaacctatggagtcttccaaatttaccgacagctctttcatattaatctctcttctaatataagaaatttcttttttaaccttccactcaaaaagattatttcaaaaagtgcccacaactgaaggagtgacttaatcaggttctcaaggaaaatgcctctctttactttgcaccttaagctctgccattgttattttatgttttgtgcatatatgaacttttcattcctgtctttaaaatatttatcagtcatataaaatttggataatggtgagaagcacaaagaaggagataaaaatcagcaaccagataccaactacaatattgtaaatatttaggcaatatagtccttgaggacttagattttcgattagacatcactgtcattcattacatcagtaggtgaatgagacaaattaattcaggaagctataaatgatgggaaatctctggtatgtcaatgtaggataggtgaaggctggcaagagagttctggtttagaagtggttagaaaagatctctgtgaaggctgaggaggagcaatctaggcaatgcctccaggtaggaacatggttgtcctgattgaggctaggacctttagagtcatggacaaggtaggccgtggttgatcttaggttagtaatgcaggagaagacagttcatgtatgcttttggtactatggtgaggaattcagattttattttcagtgtggtgagatgccattattgggcttcaagcaagggacctatatgatagggtctataggtttttgtttctctcttaaaattttttttttttttttgagatggagtctcgctctgttgcccaggttggagtggagtggtgcaatctagtctcactgcaacctccacctcctgggttcaagtgattctcctgcctcggcctcctgagtagctgagactacaggcatgcaccaccatgtctggctaatttttgcatttttattagagatggtgtttcaccatgttgaccaggctggtctcgaactcctaacagggatccacctgtgtaggcctcccaatgtgctgggattacaggcgtgagccacagcacctggcaaaattttttaattggtacataatatttgtacataattatggagtagatgtcatattttgttacatgcatagaatgtgtaatgatcaactcaggatatttaggatattcatcacctggagtatttatcatttctgtgtgttggaagatttcaagtcctctcttcttgctatttacaaatgtacaatatattgttgctaactctagtcaccttattctgctatgtaacattagaactccttccatctaactctacatttgtactcattaaccaacccctctttatcactctcactcgaaccactgccctttacacacacacaccctccccagcctctggtatgtatcattttactctctacctccatgaataactctggctgctgtatggagaatggattttagagagcaagagtgcaagtagcaggggggagatttggagtcaagagatggcagtacttggctgaaggttggtagtgagaggtaagaaaagaaaacagtcaagaaaaatgatatttttgcttattcatattaggaaaactaggtggggagctagtttggggaaggaaagcaaataagagttctggttttggacatgtgaactttcaacttggttatagtagtgtggaattcaagggagaagttaggattcaagatataaatcaactagtaaaggagaagttataggagttattatagtatttagccttctaatctttttcatggtttgatttaatatttttagaaaagactggcactctaatatctgtttatgccctatataacttatttattaaaacatggtatgtgcatttatatatctatgtatagatagacataaaaaatattttcatgtatatttttatataagtactatattgcattccattgtatggatgctaccatttgctaatcagttctctacaactggacatttatgctgttatattttattaatttataaatgtggtagcttttcaataaatcttgacaaatattcagttttttttctagaacaaattttcaatgagaagtagtactgggagaaattttaagaatttttatataaaaatacgatttgcattccatatcagacacctaatgatggatgctcaataattatttatttgcagactgattacagtctcattaggattacataaaggtgacattttctcttggctttggcaaaaccgaatagtgcaatttataataatgtcaattttgtaggcaaaatagcttatttattttacatatgtaaaattagggaaatgttaatatttttcatacttttcattaggcatttgttcttttgtaaacattcactcatagttgtttcctgcttttgaataggtgatcatttttttcctcattgtaaaaactctaaatacatatagaatatttaaatttttatcataaatatattacatacttgttttctttcatatttgttatttacttcttaattgcatttgtgagtttcttttttttgagagggggcgtgacagaggaatgtacaggagactttagtattttatgttgctaaagtagacttttaaaatattctaaaggaaaataagccttggaaatctaagaattattttttgtgaattgaaaaaattctcaatattccaacagactcaaataaatagctgagtaaagctaagtacatctagtcaacattttaaaatcatcttcccatttgttttcttgctattcattttttatttgtcccatctgttctttgttctcttttcctgttttctactttttttagattaattgaattttttatttttatttttaatttattattaattttttttgtgatggagtttcactcttgttgcccagactggagtgcaacagcgcgatctcagctcaccacaacctccgcctcccaggttcaagcaattctcctgcctcagcctccccagtagctgggattacaggcatgcaccaccacgcccggctaattttgtatttttagtagagatagggtttctccatgttgaggctggtctctaactcctgacctcaggtgatccgcccgccttggcctcccaaagtgctgggattacaggcatgagccaccaggtccggcctgattgaattttttaatgattccatattatgttctttgttgacctattagctataaatctctgctttgtattttagtagctgttttaggatttttcatatatctctttaactattaaaatctatatttgtgatattataatacttcatgtgtaggaaaattgccttacaataagttttttcattttgcctctcctggtctttgtggtattgttacatatatttcacttttgcccatattataaatactatattgcattgctattatttttgtttaagcaatcaataattgtttaaggatatttaaataattatgtctatatatacacacatatatatgtatatatagaaaaatatatatatttactaatttagttaccatttctggtgctcttcattcttttgtttagatcaatataatcatctggtattattttccttctgcctggaggacttgctttaacatttcaagtagtgtgggtctgctgctgacgaattcatacaaattttgtaagtctgaaacagtctttatttatcttcattactgaaaggtatttttttctcagtagtttttttttattccctccttggtattttaaagatgtgcttgactgtcttcttgctcgcattattttgataagaaatctgccatctttcttatctttgttcctatgtatgtaacgcatcttttctctctgcctgtttgtaagattttctttttatcacagatttttaaaaatttgattatgatgcacctttatatagttttattctttttaaattattttttcaaatgtggcttctatttcaactgattgaattttttcttcctcattggtcttatttttctgctttttttgcatgcctagtaattttttattcaatgtcagacattgcaaattttacttgttgggagattttattattattcataaaatttttagttttattctggcatgcaattaatttacttggtaagtgtttcattctgttagttcctgtttttatgattcgtaggctggactaaggcagtattcagtctagaacttattatttccctctccttatatatgactctctcaatagtaaacaaaatgattcttaagtctgaatatgacttagtggcagtggcatccaaaggggcagggtgatgggagtgttccaccctgtagagaattttataataattgctgtgtttactgtaaaattttataaaatatgtataagcttcatattagcacattattattacttattatattttttatatgaaggttaattcagagaactcccaatttcataattatctcctagcacacatgggctcagccacagttatttgttttcagaataagttcttttgggtttatcattgtttaaacttgtgataagcgtttgttgtacttttgtaaatatttgcttatatttaccaccttctttttaatacgtgattgtttttgtttttctcattttaaaaactccaaatacataaagattattgaatggtgtgtttatcataaatatatttcacacttgttttcttttatgtttgttatttacctattaattgtattaatgggattcttcatttttttgaagggggaaagcgtgagagggatgtacagaagagtttcttcttttatattgctaaagtagcccatcttaagattttttaaaggaaaaaaaaacccttggaaaactaagaattatgttttggaaattgaatatttgtcaatattattcctcctccttagacatgactctcttaataataaacaaaatgactattaatttaactctgaatatgactttgaatattttctctttgtgcagcctaagattgctgcatttgtcttctttctatggtagtacctgttttcatgtaggatcgttcccctaaatgtttgtcaacatttggctgtctgcttatattaaaaatgctgtgcttgaaacctattccaaggctctccgtgggtaggtggctgggaattgtccatttggcttctctcttggaagatcccagtaggaaaccctcaacatcagtatcttcaggtcatattctttggagtggtcagagtccccagagaaagaaaacattcctccactcttctacagatgtgaaatacacttgcccatcaaaatatggagagatagatgaggaaagaataatgaaagtatcaatacataatctcgagttttgagctttttcttttctcacaatgttacaacctcatccaaccagactacctagaatagtgatcatggttgacatgtgcagtcctcacctgtgaatgatatacctcagtcctggggatttctgatttaccctttgcagggaattaccctcccatctgtttccatagtggtgcaaggtaattaacccagcagtgtggagtggcctaatgtgagagaaagttctgtttgtttcttaaccagattcacagaagttctccatttttaaaattgtgctttctacatcccaattttagaggtatcatttctgccattttctcagattttggaatttttagaatctaaattgagtttccatcaatttttctgacttctagataaactgttcacctttctctggcctgctgagtcagttacattattctctgctttctagcatccaaaaggtgttttgttgattcttataccctttgttctttttaattcatgccttcctacaattcctttactagagatttattgcagtttcatgatgaagttgacctcagtactgtattcagcttaccatcttaatactcacatatctgcaaacatctttccatagcaattatgtgaagaaagcgacgagcatatgtgtaaaattttatttcagcttcatattggtatctttatgcacacctgtgtagttcttttattcttataattctaaaatgttggctagatgtacttaggtttgtatagtcatttgttttgaatgttaagaattttcaatttacaaaaatactctttttcaagagtggctatcttttaggatatcttaatcattttttttcccactttttaaagatctggtattttcttaaggaacaattatctatatttcagaattctatactcatccttctttatatattattagtttttgtaactttgtatcttttgtttttcacttcccttctgaattctaaaaatgttcttgtgttttaatttttttaattttttatttttttattatactttgagttttagggtatattacttacatctctgtaaaatgaattttgcttaatactacttccagtgtaaattttgattctacaatttgatttgtactcttccttaaaatatttctttatttcacctatctttcttataatttcactcattttgttttgcatttctacttgctctctctgtaatatttttcctgttttcttaatattcatttatttttattctctattaaagattatgtgtagtttcttctaagtttttctgatctttcagtatatcatttttattattctgttttttctgagtctattgatttttctttatattgttttccaacatttcttatttttttctttattcacctttaaatgaggtaggattttggttgatatttgttctactgttagcctacttgtgtgtaaacaaattagcttctcagataagatttcaagacttaagtttttcatgtgtgtttttttttttttgatagaccactgatctatggatatgagatattttctatctccactgttttgttctttaattctctgaactgctgtagtgcattaacaaatgttagtttctggttcacttttctatatccaaattctatactcaacacattaccagagataacttcacaacagaatagaccattctaatggagtcccatctgttcctggcctatgggtttctgaaatataccaccttttctcttgtgcagaaaaatggcatgggtgagaaaaggtctaacataatgttcagctcacagagtactactgtccaaaagacagagagagcaagcatgtggccgggtcttcagattagtagttacttgacttctgagtcaataaacagtaagtaggtaatattaaaatcatagcccaacatttttcaggcagtacctctgtattcccttgaacttaatatgcgtcttgtccaaacctgggtatttattttctccatgaaaatccatatggttcaccattcaacacctgattctgagtctcagctttttcatttattagttgtttgaccttgggcgaagtctcactaaagcttaattttctcatttttaaaatggggaataattgtgagaattgaatgagatgatgtttataaaacttgtggtatatatatatatatatatatatatatatatatatatatatatgtaaatatatataggtatataataagcatcattaaatgttaatggccatcattacaaatagagtcagctttttcaaaattgccattcgattgccagccttcagttttgatagtattgtgagtttccatatttttctttttctcacccccaattgatattccaatcagaaggtaggagaagtcatattataagttaatattgtttcaatccaaaatctctttaattttaacatttctatgttaatttgatttatgggtgttgtcagattgttttatgcagtctgagatcatttgtcttcatgtgaaggagctgaagacattaatattgattatgataatagatactctggctttattagtgtcattattttctattttctttcattttcttttcctcccatttttgtttaattctcatttagtctcctggtgcaattcaatcaatgtatttggtatgaagtatttcaaaaatagaagtcccatttttgcataaattaaaataatgtggaaagtagagacgcatcaaatcaatcattctttctcccctagttgcctggcccagtgatgtactaaaagatgaagtatactccttactagcaaggtttttcctctctttgcccagcagccctaccttacttcccaccaacatgtcctccgagccacaccttccaggatttaaagcactgcttctactttgccagcaccaaagaaaatctgtgtagagaattcttggcttagttgctctctgatagatgctgtatagaatgatataggtcataaatgggagtatgatggaaggggaagcagttatcttgcagccactaaggacctggaagcaagatgtttccttcatcagagcaggttaaattcagctgcgagtattacagttcaagttagtggcttaagcaaaatagaactacatatttcttccatgtaggagtagttcagaggtaggcaattcaagaattcatggttccaggaactcaaaaacttgctcttgtttctcatgcctggctgcttacataaccaaaattgcttcatgattcaaaataactgttgatattctggccactgcatccacgtttcatgtagcaggaaaggtaaagagggaagaacaaggatatcccttccttttaagagaatcttaagaagtgtcatgacaacactgcttcctatatcttataagatcttagtagccacacctggttgtaagaggtgataaggaatgacatttttatcactcagcaatgtgcacagctaaaataccaggattcatttacatcagaataaaggtaaatggaatttgggctaattattgcactgtgacacatctgttctgtgtttggggttgatgaaaatgccccgtatcacatcagtagcagccagtgatggaaataccaagtgtgctctgaacacctgcatggggtttctattgaggaagtgagactcaagcttactgtttcctgctgcactccattggaattaaaattggtgaacagatttctatgattcctgcgctcattgctctttttatcctattagtggacaactaataaacaaagagaatttaaagtcaagtctactgaagtggccaaccgtgttgtctaaaaggctaagaatgtgaatgttttctgacaggtacattacagcagttttcattttaaaatttatacccaagaatatgtgggttactgcttgtctttgatttatttttaatgtggacaatgaaccccaaacatgaagaagatggtttggcgaaatgtttgtaacatatgtcctttgggaagtggcttcataaactggagaatagaacaagaaatctacgcttaaatctcagcttcaagacttcaggatcccaagtggtgatcctggggctactgctaaaattcactgagattcagcttgattatatatgaaaacagagatcaccttcaatctcatcagccacagaacctgtcacactgtgtgcatctctatctccatgcctggggtcatgcctttatgcatgtaaatttaatggtctcctcattctaacttcctataagattgaaacacagaggtctgcggggcctttcccgcttgacccataatgtaatgtaaagacccatcctaacactggccttgtgatgggccctccctgtctcccttcttttacatcattcccaacaaaagcaacccatcatagttattttactaatagttgagtaaaaaatgtaaaattacctctctctctattacttttagaatgtataaaaatcaacagggagtcttcaccacaggctcctaatatgaaagtgtctgtgcaggaaaatccataagctagggtgacttttgagttaaattaaattttatggctcaaaaaatgctttgcttggttttcactaccattataaagcaaagaggataatttcagattcagtttctacaaaggattgctttgggttgatacaggctttatgttagtggcatggaagtatttgcatctgcacattgatatgtagtgaaataggctgtaaaagataagatcaatttcctgttaaaggtaaaaaggccaatgtagccagatacattaagttttttttttttccatttgtcattcaggactgtttgacagttttacattagctgtgaaaggcaccaactggtacactactgtcaagacttagaaagtaggcacacgtacacaaacacgcacacatgctgatgtaaaatataaatataaacagatagaagcctggaccatacatatgagtgccaaaaatgcagttgtcacatgcatacacacctattaaaacatagcaacacaatcttatagcaaagacatgcacacacaggtacaaggacattgaccagatgacacaatgacacagctgggattgacaattacaggtgagcaagcaagatgagggctaatgtccataggagccaagagacctagagaccctcatgtaaacacacagagatgtatgcatatgtgaacacacacacacacacacacacacacacacgcatgaaaagagagacccagagacaaggccagacaagaacacaaagatcaacacttacgtacacataactaaaaggcatgctccaaagtgtgctagagactcagaaacatagaccctcactcattcatgtagccacggcctcctgacctctggttagctatgttttcattttgtactgagacctttaaagtaatttatttgcttcaagactcttcattgactcctccttcgtccgttatatttggtctactttgaagtgtaattcatttcaaattatgtttttaggtttaattcctacaattcaggttctcatgcatcatctggactattacagtggctaccggaaattacctggagtccgtctagccctccccaagtcattcaaaattacccatgtgtggtacatcattactgggtagaagaactgcttctaaaaccaaaaaataacatagagttcattgagtccattttatatgtaaaattttgaaagactagtagtcccattattgcacacacatcaattccaaattgttcttttcaaccttgagtaatttcaaggttgaaattaaccattctcctttatcttttatcctctatccctttacctttatctcccttcatacttacctctttccagccacttaaattttccttgtttcctctttatgcacatgtttttttcgtatctccataattttgcccatcattaagccaatctttcctcattctagcctcctttaataatgctaatatgaatagttgcctggcccttcgctctgacaattacatcctatttcttctgtttgttttaagtttagaaatcccacctgtattcaagatctcattcatttatatttcaagccttaattagtaggctgtatcctcttgtagctataagtagcacagagcttagtactgtacttaatttttctttcagtccttttcaatatatcagttctccccaaatgaaatacagtcttccagaagacaggatctccactttcttcttatccttggcattttccaacccctggctcactctgttatgattttgagcactccacatcctcatactggggcatctagttcctgctgcttaaacttctgactcccaatgctgtatcctcaatcccagttagaattccaaactccagatctctacttcccattttctaatgattgaagcctatttaagccccatggattaatttcaatttacaaattcctgaaacagtacaaccctttcccattatcttactctaaattgatttttccctctcttttttaaaaaaattatggttaattgtcctaccatacatccagtcatccaagttagaatctcaggcattaatttttaccttcttgtttcctttgtttcttccccaacattagggacattaagacctacccttatatggccttgctacccatcactttctgtcatcctctctgagtgctgctctgggccatcccctcaccaacacgaggtcaggcaagaggggatgattggcttcaagctgcttctttgcttgcaattttgcctcctgtgatcagcctctctgatgctaacagaatcatcattctgaaagacaaacctgatcttgtctttcttattgaaaaaaaactttaaaggctcaagagtgccctcaaataaagtccaacctcctttagcagcagcgccttttacagcatcaccttgacctaccatctcagctcaaccatcccttcccttccatttgcatccagactatactttcctctaaatgctgaatacatcatgtctgtgatcattgtttaccaatttccctttatccaaatgcttcatttactgttctacctgggaaactatgctagattttcaagactcagttctgaaggcatccacaatttgctctgggaaaattaaacatttccataacatgttctacaaacttgtaagatagcactcattatgtggttagctgttcacatatctttctccctaattggactgtaagtccttagagaatagatcctatatcttatccatcattgtctgcccagtatgatgtcaggtaatctgtgcatagaattattggctaagttgctcatgccaaaaaatacatactttggtagacggatactatttattgcctacctaatataaattctctagttgatatatatcatttcatttgatttctacagtaactccatgatatagttgcaattgttcctgttttcctagtgagatatctgtggtctagagaaaataagaatttgaccaggttagtctgtttacttttcttttagcccatcatactctttccgtcagcagaattgaaaacgtgttcataagacattacccttgcatccaacttaggaagctctggaataaacaacaggagcaagtttcttcttgtagtagttctcaaagtctttaatacattaatatgaatcttcaagtttgtctatactgcacagtacttcccagatctattggctttagaagccattttatgagattctcatgcaggatatcctttgggaaatgtaaccttatatgaaaatgctgtctttaaataacttctggtgttcttagtctttaggagagaactcctctttcccaactctttctcaggagcatatacacatccctacccaagtgcttcttcagtgatactaatttctgactgaagtgattggcacatcacatcctggaatcctggagacctcctcctgttatatgcctctttttgctctcagcagagaggagagagatagaaatgcatgcttgctgctccctatatgtttctatccatgcccaaacacgtaggctaccctctgtcacagagcacactgaaggggagagaatgcttggattgagctgattgaactccttggttgtctcccatctccagcggtgtttggtttgggttgaatgctgtagagttgcctgtaccttctgcactctacaggagaagctgatttatttttatctctgtctgagaacaacaacatggcatcccctgatccccctggtaatttcctgggctcaatgattgctgttttccttgacctgtttcacagctggtggcactgctactgacctggatttgttttccttagctcaaatgacatagtagcccaggagatgcatggatttgacaacacaaagcctcgatttttaaaacaagacacacacacacacacacacacacaaacacacacacacactcggagggtttttggagtcagagagaacatcagttccacccctagctccaagactccaaatttcaggtctgctgcttgccaattaggacaagttactcaacatcgtagcctaccctttccttacctgcgtaataatgataatattatctacctctccgggttgtgaagaggattaaataagataccttagtgccttgaagatagcagcagtcacttaatgtttgctatgtttatattactatcatttttcaatttagacttttattgtttccctttattacatttactgtatattttctttctcatgaactacctatctaggcctgattgtgtgttttttaatctaaggagaaactaaaagaaaaatctattgatcctttctacaaagggtttgtgattatctgaggaaattaatcataaacataggaaaaggttacctatgatatatgcaatattttaattatttttaaaagaaaaggttactttgtagataaactttttagataaatccattaacactcaagtttaatgtttacataataactgagtacaaagaccaagatttgaaaagaagttttttatgtgcgtattacttagagcataatccaactaaaccagtggaactaaaaactttcaagcctagaaagtttagattcttagaataattttttttgacatggtttttctttgtcatgaaggctagagtacactggagaaatcacagctcgctgccacttctacctcttgggcctatgtgatcctcccacctcagcctcacgggtagctgggaccacaggcgtgcgccaccacatccagctaatattttctatttttttgtagagacagaatcttgttattaaacatgaacaaatgggataaactaaaagaaagattaattcagtctaccaagactaaattagaaagaaattaaaaatcggaacagacctataaccagtaaggagaagaaaaaatattgccctggttgatctcaaactcctggcctcaagcagtcctcctgcctcagcctccaaaagtgctgggattataggtgtgaggcactgtgcccagcccatgtaaattatcgaagagcccaaagagcttttgcttatgtgggtcttacccatcaatattaatgatagtaaaattaatatgagaagacttttaaaatattttattggttaatgtagaaaataaaaataaaaccaatgtattataaatattctaatgaaaaataaattattttccaaaacgccctcacacataaaaatgagaaaaagggatgatgtacatgcatatgtttcattgtgattaaaaatgcataaaataaaatttccccttttaacaaaattataagtataaaagacagtattaactataagcacgatgaggtacagcagatctctagaagtttttcattttatgtgactaatactttatatctattgaaaagcaactgctcggttagccctttgcccaggcctgggaaaaatcattctactttctgcttctatgagtttgactattttagatactttatataagtggaatcgagcagtatttgcccttctgtgactgacttatttcacttagcataatatcctgaagatccatccatgttgtagcatttgacagaattttcttctttttatggctaaatagtattttattgtatgtatttacaaaatgctgtttacctatcaaaggtcatttaggttttttatatctcttggttatagtgagtaatgctgcaatgaatatgggagtgcagatatctctctttgagatcctaatttcagttatgttagataaatacccaaaagtaggatggctcaatcatattatagttctatttttaaattcttaaagaagacttcatagtgttttccatagcatctgcaccattttaggtattccaaccagcagttcacaggggttacagtttttccacatttttgtcaacacttgttattttatgtttttctttatctttgtaaataaatataatggccataccaacaggtatgaagtgatatctcattataattttgattttcatttttctgatgatcaatgatattgaaaatcttttcatatacctattggcatttgtatgttttctttgaagaaatgtttattcaggccctttgctcatttcaaatcagataattggagctttttttgctactgaactataggagtttttttaaaaattatattttaagtgttaaccctttatcagatatatggttggaaatattttctcctattgtgtaggttaccttttcactctgttaattgtttcttttgctgtgcagaagctttttagtttgatttagtctcacttatctattttttcttttgttgtctattctttcgctgtcatatcaaaaaatgcatttccaagaataatgtcatgaagcttttcccttgtggtttattttaggagttttacagtttcaggtcttacatgtaagtctttaccacattttgagttgctttttatatatgctgcaatatatggattccatttcattgttttgcatatggatttccagttttctgaacatcatttgtttaagaggctatcttttctccattatgttcttggcatccttgtcaatgattatttgacgataaatgcattggtttatttctgggctgtgttctctgttcccttgactatatgtttgtcttatgccagtaccatatttttttattactgtagctttgtaatatgttttgaaattacagagtatgaggactctgacattcctcttctttttcaagagtgttttaactatttggggtcctttgtggttgcatattaatcttttcttttatttctgtaaagattgccttggggttttggaaaggactgcattgaatctgtagattgctttgataccatagacattttaataatatagtattaagtcttccagtcaagaaaagtagaatgtatttccatttatttgtgtttttcaaaatttctttcagtaacattttgtagttttcagcatataagtctttcttctccttgcttaactttattcctaagtgttttattatttttaatgctattgtaaatgtaattatttttttaattttcttttcagattgttcattgttagtgtataaacacaactgatttttgcatgttgattttatatactacaacttttgttgaatttatttattagttctgacaggtttttgtgtgtgtgtgtgtgaaatccttaggagtttcttcatataagatcatgtcatctgtgagtagagattattttatttcttttcatttttgattattttatttctttttcttgttaaattgctcacactagaacttcagtacaatattgaatagaagtggcatgagtgacatccttgcctcgttcctgaccttaggggaaaagcattcaggttttaactgttgaatatgttgctagtggtgagcttattggatatggcctttattatgtttggtaatttccttctattcctagtttgttgagtgattttattatgacagaacattaaattttttcaaattctttttctgtatatcttgagatgatcatgtgatttttatcctttattctgttaatgtggtgtatcaccttgattaatttttgtctgttgaactatcctttcatcatagggataaattccacttggtaaaaaagtatataatcctcttagtgcgctgttgaatttgatttgttaatattttgttgagatttttacatgcatattcatcaggaatattgacttgtagattccttttcttgcagtgtctttttctgcctttggcttcagggtaatgctagccttatacatgagtttggagggggcccctcaaccacttctcaattatttggaagatttgagaagaactgttgttaattcctctttaagtgtttagtagaatttaccagtgaagccattggtcctgagtttttccttgttggatagttttttgttgttgtttttgtttgttatgtttggtgttttaactgattcagtcaccttacttgttataggtctgttctgatttttcatttctttctaatttagtcttggtagactgaatttatctgtttcttttagtttatcccatttgttggtgtttaattactcatagtaatttattataaccctttatatttctgtggcatcaatgtctcctctttcatttctaattctcttcatttaactattttctctcttttcttagtttagataaatgtttatcaagtttatctatcttttcagaaaacagctattagttttggttttttattgtttctattctctattttatttatttttgttctaaccttcattattttctcctttctggtagctttggatccagtttggtcttttcctagtttatcaagttgtagaattaggttgattatttgagatctttctcctttttaagatctttcttcttttttaatgtcagtgttcattgcaatatacttctctcttactactgcttttgctgcatgccataaaattgggtatgctgtgacttattttcatttgtctcaagatatttctaatttcccatttgattactttttaattcagtggttgttccagagtgtattgtttaattttcaactattagtgaactttctaggttcattttggtatttatttctaatttcattccactgtagttagaaaacatacttttgataagttagtcctcttaaatttgttaggacaagtcttgtgacctaacatgtaatctatcctgtagaatgtactgtgtatacctgagaagaaagtttattctgcttttactgactggaatgatccatatttgtttataaggcccatttgttttatattgtgcaagttctctttccttattgatcttctgtctgaatgttctggccattattgaaagtgggtattgaaaggttctactgttattgtgttgctgtgtatttctcccttcagttctgtcaatgtttgcttcatatgtttagatgctctgatattgtatacatatgtatttataagtgttatatcatcttggtgaattgacctttttatcattatataatatccttgctcttgtgacagtttttgacttaaaatgtattttgtctggtataagtatggccatcctgctctatttttttttctttttgaatggaacatgtttttttttccatactttcagtttcaacaaatttgtccttaaatctgtatagtcttttgtaggcagcagataattgtatctttttaatctactctgccactctatgtcttctgattgaggagtttaatgcattcacattaaaggagttcttgaaaaggaaggacttctttttgccattttgttgactgttttctttcgtttttgtagtgcttctggtcctctttgtctcttttgatatcttcctttatgtttcattgattttttatagtgacatgcattgttttctttctcatttatcttctataaatattatctttagcattaccatggggcttacataatcatattatagctttaatagtctattttaagctgataacaacttaacttcaatcacatacaaaaactcttcactttaacctctgtcctcctctaccctttatgttactgataccacaaattacatctttttatgttgtgtatcaaatagtatatttttatagttattgctatttttatgcttttgtctttcaacttctaaaccagaattaaaattgatttatgcaccatgcttacagtattatagtattgtatatttttaatatatttatctttaccagtgaactttatattttatatgttttcagtttatcatttagcatctttcagtttcaatttttagtactccattagcatttttttgtagggcaggtctagtggagtggaactccctcagttttgttcatctgagaaagtacataccttcattttttaaggagagttttgccaggtataatattcttgtttggcattttttaagctctatgaatatatcatccaacttcatttttgactgcaaggtttctgctgagaaatccactgatagtgttatgagagttttcttctacataatgattggatttctgcttgctgctttcaaaattctctttgtctttgaattttgacagttagattatatgtgtcagtgtggacttccttgggttcatcttattggggattcatttgccttcttgaatctgagtgcatttttccttctccagatttgtgatgtttttgttgtttctgtccagtaattttttaaataaacttttttttcttttctctctatctctttcctctctctgttctcccctgggactcccataattcatgtagtggccagcttgataactttccataagtcacttgggctttcttcattctgtttttcattcttttttcctttttgctcctctgactgtataatttcaaatgacctttctttgggttcgttaactcatatatctccttagtcaagtcagctgttgaaccattctagtgaatttttcagttcagttattgcattcttcaggtgcaaactttgttttgctttttaaactatatcttctatatttttgtctgcggaccacatactgagaactgctggtctcagctgctgtaacaaatatacccaagaatacagaagatcaaacaagatatttaataaaataatatttgctcatgtaattgtctaatgcagtggttctcaactaggggaaattttgcccctcagaggtatttggcaatgtctagagacatttttggttgccatgactggggagagagaagttactggcatccagggatgcaactaaacatcttaaatatacaaaacaatctcccagaacaaagaattatctaacctcaaatgacaagttgaggtacagaaactctggcttaaagatgggagttgaggtgaggaagatggttatctcctccgcaagatcatctaagggctgaggttccttcttttctagttgtcgtgttgtttcccaaggagttgcccttgtctacagagtaagtcctgcctcactgggataacatctacttttttgcaagaggaatagaattacatgagcaattaggtaagcaaatatccttttatcttgtttgaccttctgtattcttgggtatatttgttatagaagctgagaccagtggttttcaaggtgtggtctgcagagaaccttataggaaatatctggtgtcaaaactatttttataataatgctaagatattatttacacttttcactgtcttgacatttgcaccgatagtataaaatcaatgtctgataaaactgctggctgcttagtacaaatcagctgcttagttgagaacaataaatggactcaagaaaataacgtggaagttgtacacatccttccatctacttacattccattggtaagaacttgtccaaatggtgaggctaagaccttgacatggaggaaggagtccatttaaaagggaaattcagggaatggtttctggggaaacactggcaatatctgccctgatagagaaatgctttaaagcttttgaaggcatgctcaaagaagtcagaggccttttatcatagaacaacttgaaatttttatttatgtataataatactttctatatgtaaaagaaacacatttcttgttatattttgcaaacccatgacttacaatgaatttgccattcactttctggagacaattaattcctcggggatataataaatattcttgcccaaacgaagaatgtgttactttggaagaggtcattagcttctacaaaatgtaagtaagctgatatcttactggtttatgggacttatctttgggctttattaaaatcctgcatttttaacttgaaaaagaaaaggaagacagacattgacttactgtcaaaatcaacaaggtctggatgaaggccccttgaaagtctcatccctgtgagccggtaaacatttatatctaatttgaaatgagatgcttaattacataatttcattccaattaagctgctaattaattgacagggcacctttgagagctttacacagtgcaagtaaaaggcaactacatcttgagtctattacctatgaccgtttgggagagatcagtaaataactatttaagaggctggagacagagtttgcaagaagagaaaacaagaggctagccctgggagatccagactcaggaccagtcctggccaagactcttttgagcttttttttcagtctatttcttgagtgagtaatgaaaggaaacaaaagaaaaaaaattctcttactgagcatttactacatgtatgtgctaggaagctgcaaatgaaaaatgtaagatgctagactatctgcccagttgttgttttaagtaacactgttgtttgggcattaagtaagtagttttgctatctccctggtatttaacttagccaggtctttcttcttgtttttccatctctgagctttattctggggtcaaattaaagcttattttgtgtacagatcatcaatgtctatttaatctccccagagggtagtaatgcttttgttgatagtgaaaacaattccaaattgacatcagtttttcaaaataaaatggattattttactacttgcatactgcagcttattagagtagaaacatataacaataaacatctattcatacacacatgcatgatacttcacttgcctgcactggagaagaaattattggaatgtatctttttcatccagtttaatgcagaagcagaaacctagggtggacaagctggttgtctcattactgaacattactgttgactcaagagtctttccacattacttcagaaatgctccaggactgcattatcacatctttacatctcatcattggttttattctaaaaaattaatgaaacaagttcgagttaggtttatcattcaatctaaagagtttcgtgtagtatatcacccactattatcacctagtccataactggcatcatgcatctttttaaaaatattatttgaataggtacgtttcctcacagatatatcaactattgtgcatatctctagttctgattctagttaatcaatatcagcagaaagcttatcatttcatgtctaagtgtctgtgtgggcatgaaattgttaggaattgttttagtgaataactgattcaaaaattcattgcttaaaaacaagatttttttttacagaagcattcagaactccaaagagattataactcacagagaattattttaaaaagcagataatatcttattccttttttccacacatctccacataccaacttaaatcttcaccagtaaagaggaatccaggggaaatcataagagaagcatctttgctatcctcgctgaagtgagagacagtgaacttttcctttgctcatactcagtgcctagaatcacctaggaaagccccttcccatgggaactcagcagccatgagcaagctgcccttacaggctccatcctggtcactgacaggttactccggctgtgaccactgaggtccacttccactaatgcctcagaattttaacctgagcctgacaaatttgcagggtatgtgggcacacattactgtatattgcagctggaatgcaaacaaagtggaccttaatggcaattaaatcccaacccctcattgtacagatgaggacctttaaatgcagataggtgacaagcaaatatttggttgtggtcaatgttaatgttgaattgattacttaatcaaaaatcacgagattgatccatatttagacaaacatctatgggcttacacaccgatggaatttacaccttatgtatctgtatacattatagactttctggacattcaaatccctttcgtagaagattctgaggctttgagatactggactctggtctggtaagacttgtttctctccacatggtactgccagctgtaacacagggaatcccacttaggagcatatgcagggaaaatgatcatcactttgccaagccctgttttatccttacttcctggcatcaaagctatcttacctgatcttactttccactagaatagagcccaatctaggccatcacccaaaaactggaggagactttttggtagatacttgtaattgagtttattttcatatatttagtttaatgcaaaatataaattaatgaataaaataaaatattcagaatgtctttttttaagccaagatgataagcattccttagaatgtatgtgatggagtaatatgacacatgtggactagaatattactgaggccgccaacagagatggcaacactaacaaaagtatggcttaacattcctaaagctttgatttgttgccttcttgagaggaggtagttttaattcgcttcttatatgccattaaggcatcgttgcctctggatatttatgtttacttatcagtttatgatagctattgatttttaacagttattttaaatctcttgaagaaacacatgcaaagatattttcaaaattcatagtttgctgttaatcacttatgtcctgaaactattgctaagcaaaagttttcattatttgttctttgagggagtataaatttaatttagagtgagaaggataaaacccaggattcgtcaccatcatttcaaaccagatactgtgattttttttgcggggaagaggttgagagaggcttcctggtttgctcctttgttgattttcttacatatttgacagtgtcaacattgaggctcaccagatcactgccaaagcccattgtgaagagtggctgggccagtgttttaattttggtatatattgaaaggatcgtattctataattgactatgttttacttagatggcattactgaatgtacattttcagaatttattttgaagactgacatcatagaagaagctcatctagaatactatgttcaagcctttgaaatactcaaagaactctatagattcagtgtaatccctatcaaaataccaatgacagtcttcacagaaatagaaaaaaaaaaacgtaaaatgtatatggaaccacaaaagagaatagctaaagctatcctaaggaaaacaaaactgaaggaatcatatttcctgacttcaaattatactacagaggtttagtaaccaaaacagcatggtactggcatacaaaaagacacagacatcaaaggaacagaatagagagcccagaaacaaatacacacacctacagtatactcatttttaacaaaggtaccaagaacatacactgtagaaaagacagtcacttcaataagtggtgctgggcaaattggatatatgcagaagaaggaaactagacccctatctatcaccatatacaaacatcaaatcaaaatggattaaaaagttaaacctaagacctcaaactatgaaagtactacaagaaagcattgcggaaaatatctaggacattggtctaggcaaagattttttgagcagtaccccagcataagcaaccaaagcaaatggacaaatgagatcacaaattgaaaagctactgcatagcaaaggatacagtcaacaaagtggagagataacccacagaacgggagaaaatagttgcaaactactcatctgacaaggaatcgataaccagaatatataaggagctcaaacaactctataggaaaaaatatctaataatctggtcaaaaaatgggcaaaagatttgaataaacatctctcaaaaaaagacctacaaatggcaaacacctatatgaaaaggtgctcaacatcattgatcatcaaagaagtgcacattaaaactacaatgagatagaaggtggtgtaccagaggctgggaagggtagcgggaggctatgggagaggtgagggtggttaatgggtaccaaagcaaatagatagaatgagtaagagctacaatttgatagcacaatagggtgactatagtcaataattactttattgcaaattttaaaataactgaaaaatgcaattggattttttgtagctcaagaataaaattaaagaacatggagaagggcaaaaaaaactaaaaacaaaaattaaaaattttaaaaagccatgaaataattaagtaaactggatattcacataatgaaatggctacttttgaaaacggtttaattttatataaatataaaaggtagcctcccacttcccttcccagcctctggtaactctccttttactctctgtgtccttgagttctgttttgatttttaaatcccacaaacaaatgagaatatgccatgcttgtctttctgtgcctgaatagttttgaataactctatgagaaaataaatcagagattttaccaaaataatagagttaaacataagatttttcaaaattttgtctcttttctagtttccttaataaatgtgtgtgttgttatatatattaagaaattttaggccaggcacagtgactcacacctgtaatcccagcactttgggaggccaaggcaggcagatcgcttgagcccaggagtgcaaaccagcctggccaacatgaggaaaccttgtctctactaaacataaaaaaattgggctgggcgtgatggctcacacctgtaatcccagcactttgggaggccaatgcgggcagatcacgaggttaggagttcgagaccagtctggccagcgtggtaaagccccgtctctactaaaatacaaaaaattagccaggtgtggcggcatgctcttgtaatcccagctacttgggaggcttaggtaggagaatcgcttgaacctgggaggtggaggttgcagtgagccgagatcgcaccactgcactccagcctgggtgacagagcaagacttttctccataaaaaataaataaataaataaattagccagatgtggtggcgagcacctgtaatcccagcttcttgggaggctgaggtagtagaatcacttgaacctgggaggtggaggttgcagtgagctgagatggcatcactcaactccagcctggacaacagagcgagaccccgcctgaaaataaaaaaacaaacaaacaaaaaaaacagagaaattttgaacaagatatagacgattccaaaaggagcaagcaatatggcatgcagttcagaacggggtcttccaaatacaggccctgacttggtcattgcaggccatgtgtctttgacaaaacacctttgcccaattacttttatagtgaaaaggggacaataatagtgcctactttctaaagttgctgagagggttgcattagaatgtcttcaaaaagcttatcacattgcctgtcacaaagtgatattaatgattatgttcataataccattaaaaaatttattactttctaagcaggaaaaaaaaaattcaaatttaggacagtcccataataagaattaatttattttaacaaataaagttatggcttttgttttaaattgaaatagataatttaagtactttctcttaattattttataaaatgtatggtgttttaacatatgcaaagttgatatcaattctattttcttaatctctcaaagttgccacattgctatagaaataactgtaaaaacatgtgatttttccttccacttgtatctgaacagcatttactcatttaatccaaaagctgaagagatgaaaaattgggagatagtggtttcactgttcacagacaagctttcccactggctctgtgacctcaaacaaattggtttactcctctgtgcctctgggccagtgaggaagctttcagctgccaactagggaagaaactcctgagaatgccttcagcaagagcgcagccaaggcagagtagctccagggctggttaattcagttactcaaggacagtatctaagatctaaggtttcctcccaactgtatttcctgcattcctccgtatctgttttcttctcatttttcccctcatgcacacatgttggcccaggcattacccacagatataactctagtagagacaggaatgaatatgtcttttctgttgtatgcttcgtaagactgagaatctccttcctacaactccccacctcaggatctccctgacgtggcactattcagaactgggtcacatgtcacccccagtcactgccaagaatagtgagattgctttgcttggttaaagcaggatgagcttgttagagtggttagattaatcaggatttgtctccgaggtggagaaggtttcttctgtctaggttggacagtttagcaacatttactttaggattgaattgacttgagtaacaatgcacaacatctgctgaatccttaatttttttagtctataaaatagggcaaagttcagttttatctaggtcacagaatttttaaaggataaaatgatataatgtcagctcaggcagttcaagcaagcctatgactctcaaatgaacagtggtgctttcatgataagtctaagaatccttggccaattatgtataaatgcaaccctagtctctccttcatctcctttcccactgttcagccatggctttcagagttcatcatttatttctacattgacagctaccccaatccccattccaaattcacatgatgataaaatgtacaaactagatgacttccaatcttcttattttcttaacaagtttgcaggagccattaataatgtagagcaaaatgcagtctcaggtgtgtataccaccaagatgtaacttacaaaggtaactctacaagagggaacttcattccatgttgtaaaactaccatgtattccttctgtgtaagtgggcacagggagaactcaaagtgtttatggcttagcatgcatgctttcttaccaaacactgttcttgtcccttgttgtggccattctgagttcttttatgcaaatgtgacccactaagaaggattgatttgtgctcaggcctcagccaatgcccattttcttatgccctgggatttgtttcctagctgcctctggccctgcggttgagggttcttgccagttcgattctaatacatgaacactttcctttcattctctctttctgatttccctttgcatttatctgctcccatcaatgcaaaatactgaatggttcaaattgattttccttctcaaaacaggaaaggtctgtttttcaaacttccgtacttcctaaggaaatgtctctgatcaatatgtgtaagaattaaggggaaacgccagactcccccttctgattgtcagtaactcagtgcaacccgtttacctcttaggattcttcccagcagaaaacgctaacaattgcaattatcaccattatgcagtatgttcaattgtacaatcaatgtaattgccaaatggaaattatacaataaatataattgctgctttactcctgtgcagtatttcagtggcacttcacatttattttgtcttttaattagtaacaggtataattgcagcactacactcagagctgaagctgaataatttgtgggagtgggcatagggtacagatattgaaagagggctgctgtggttcattctttgctggaattatctaaagatatccacctattgtctaaaacccacctaacagccctaaattgagctgacctgtggacacatttggtgtaaactccaggtaaaaaaattccctgcagttcctgaggcacatgactttgccatccctgctcttgacttcctgcatcccattgtccctattatttgtctatctagatgaatgtattaattcattgatttaataagcatttattgagcactgattatttacctgcaggagatatgtagtgaacaagagaggcatgaagcttaaaatctaggggaaaaatgcagagactacataaagagcgaatcaagtggtaggaaatgtaaggtgattagtgctaaaacatgctaagaacaaaaagttattatgacgtcataatatcttttgatttgatggtcagggagaacaactttccaagacatgatattcagcttgagatgataaaatgaggtaggttgttcaagtgggggtggaagaaggaagaaagtgagagagagagagagagagagagagtttgtgaggtgtgctggaagaggtagagagagaagagcttagatttagagggtttccacattataataaagaattagatatttattataagtgcaatgggaaaccaatggagagtttggtgcacgacagtgacataacttgatttctattttcttttactttttagacggagtctcactttgttacccaggctggagtgcagtggcatgatcttggctcactgcaacctctgtctcctgggttcaagcgattctcctccctcagcctcctgaagagttgggattacaggtgtgtgccaccatgcccggctaatttgggtatttttagtagagacagggttttgccatgttggccaagctggtcttgaactcctgacctcaagtaatccccctgcctcgacctcccaaagtgctgggattacagaagtgagctacaatgccagaccttgatttccattttataaaaagtctattctgactgttgtataaaaactgattgtagaggaacaagaaatgaaagaaagcagatacagagaaaattgtcagtgtctgggtagaagtttctggttgctagacctaggatagttctggtggagatgaaaagaagtggagtgattagaagaacatttggaagtggattgccattgctggttgacagaattgatgtgaatggtgagatcaagaatgaaattccgaatggtgctaggcttttggcttggaagttactggaagtctttaaaaaagaacagtcttattagtaagaaaacaaagcttgttccatttgaaatgccattagacatccaggtaaactattggataaataccctaaggggagtagtcattaccgtagatataaatgttgaggcttaacggcattgacactgaataaccctggaccagggtgagataaacatcaggaacagaaaacagaagagatctcaggattgagttgtgagtttttgcaacatttagaggttccacagcgaggaagaattggcaaagaaaattgagtaatagctgctagtcaggttgaaggaaaactaggaaccactccagccaagagaacctttaccaagaagagaaaccttaacgatgtgaaattttactgagagtaagaagaaagcaaagctgtggtctttccatttggtaatgtggaggctgccactgaccttgtcagaacagctttagtggagtttttaggctacatatatgatatgtgtgggttgaaaaaaaaatgaggtgaggaaatgaagacagcatgcacagatgatttttggagtgctgtgacaaagaacaagaagcccagttgtaggtggaggggcacatgggtcagagaggctgttggatatttttgtatgcaagtaagtgtgaaaagtgagaaatggatgctgcaaggtgggaggtggagtgctttgagaacaaagtccttgagtagatgagaagtggaatccagagtataagcaaagaggctgcctcagacaggaacagaggcttgtcttcctctgtaatgggagagaaggcgagagtgtaggcatggattcgggaaggtcagtatgtgacagtaggaggactgctgctgcctccccgtagttcgtgatctagaggagagagactcattgtacacagctcactacatgagtcagacagtggtctgagcagacagcaacaactgctgtgagagggcaccggtgggaggactctgcctaccaaagtttgacagtgcaggtggcatctgactttggcgttgaataatagatattattatcctgttatttgacttagacatcaacaggtataagggcatttcctctagaaggccgcttgcgaaagacctcgtatcaagaaagactaaggaagacatataggttgatctctttttccacagaaccctctcaggcatcagtgctttttcaaagccctgttctcctttgaaaacttcctctctccctttccttggctattttctaattatcttgcaaggctaagttgaagtgttcctcttccagaaaaccttcccagggcctacccccaaaccccttatcaatttgagttagattccttcctagatgtaggtggagcaaaaagatagtggcctctattttttggatgtgttggcatgagtgttggctttatccatctggtagaacaagaagcgtccatggtggtagccactcaagagctcaggcaaaatggtattctgagccccagagggctagattgaaggctgccaaaagagaacagtgtttgcaatcttggaaaaaatccttgttcatgtttccatggacacgtgcagttgagtccagctttgcacttcactttggtcaaagagtattttgatgtgtatcatgaaataaacatacaaataataaaaatcataaacaaaactctcagcatatgggtcagaaatcctactcagtttgtcatttatggtgggactcaagtactatcagcaccaactccacagcccagggatgaactttgttgtggtgtctgataggaaagttcaatcgaacaagctccccccaccatatctctataaaacagtcttatgctatgctatggaaaaggtttcagttatttgtctgaatatggtgggaggataatatcacctgcaccacagatacccatgccccaacccccagaacatgtgaatatgttatttgacatggcaagagggaattaagtttgtggatggaattaaggttgctaatcagttgacattgaaatggggagattatcctgcactacctgggtaaaattaatgtaattacaagggctcgtataagtaaaccagagaggcaagaaagtcagtgtcagagggacacagcatgaaaaggactcgactggccatttctggctctgaagacaaaaggtggctgcagatgaaggaatgtaggcaagaaaaggcaagaaaatagatacatcccctgcagtctccaaacggagcacagctctgctgatattttgattttagtccaatgagactagtttcagatgtctgacctgcaggactgcttttttgtgtgtgctgttttaagccataaattttgtgaacatttgttgcagcagcaatagtaaactaatatccagtgtgatgtacctctgtgcctgaatctgagactccatctaaaacccgtgcacagtcacagtgtataaatgggtgacaagatgaaaacatggcgggattcataagcaaaatgctgtgcctcagaacagtgccctttcagtaaggggatactaaatagatgacagtttttaaacagaacccctcagaacttcagtttcctcagcctgacatttggggtagtaacacatttctacattagaaggagatgtaagtaagataatgtgctatgaatggttttgtaaacatttataaatttccttgtaagatctctgcgatgattctaatactcttttgaagcactagaaagtacactggcctgagaaatgcaagagctgggttcaggtctcactttcaatgcctgtggcattcattacacaacccaatttatctttctgaagactccatttgctcatcactaaaatatggataaaaagatttagtcaactatgctaaaaggtaataataaaagtaaatgcacttttatttatttccactgtgtgtgcaaataattattaataaaatatgtcaccatacttacttctcattcttggtcaataaaacaatatccacaattccagctctcactgtacaaggtctctacatgagctacagtgagtgagtgagtgagtgataaggaagagggtgaatggcaggtgcaggaatgcccatataattggtgagctctttctccagccactgtgtccaggatctatgctcagatcttaagacaatccctgtagtcctcggtagaaagcctcttaggaatcactctttcatatttagatttattcctgggaaacttaaagctacctcaaacccagttcttttgctcagagttctcaacacaattctctgagttgtctagtgagtagaaatagaagccagaggttcatggaagtccataaacgcagtgtacatgttaagcgtttaagaaaatgctgtccgtcttgaaagcagatcaggaatctaagagtcagggtcattctctgtgactgcagtcaagatgagagcaaccaactggccctcacaggaagttttgggaggcagaaacttcattgattcatctaccttcagaatttcacatagcaccaggcacatagcaagtgaatgaatgttttatttaaaggaaatctgctcttttgaacaatataagtcttatttttttcaaagagatgtgtgttatcaaggaacttgatatgcccagaggttaaacttagttttctgactgccatttctatagtacaaaggctccagggtgctttctgtatggattagatgttaggcacacaactctcccaaacaaaactaaaaattgttccacaaatgtggaaagtatagaaaattaagtaatatatgcaaagtgatgagaatggtacacagaaaagagtgcaatgtgtttgtattatgctatgtgatctggcataggttcaattatattttcattgataattttcctataaatccatgctttggaaaatgacctgtctttgttttccctaaaggtaatgttatgcctgtatttgtgtatcttatcctagataaacaacaccagatgttgaaagagcataggaaggaccatgtgatatttatcttaagataatactagaagaagtgaggctattctagaacttaattgattcctgataaatctgagaaacaaaaattttgagtccttaagctattcatgatttccatttaagaaaaatttgtctctattttcttatttcccaaatatgttaattattgtaaaccaaatagaagcaataactgaattcttcattaataaagctgctttgtttaaatggctgtcgacatcttatattattatatagaatattatggtgacatagtcttatcaaaaaagagaacatttaatcacaaatttgtaaagcaactggattttgaaaatccatgaacattttgtacacaatagttgatgttaccttatgaaaaataaaaccttacatggttgttccattaaaagcccctgcttctaatacatagctattattttattttcattaaaaaatatggggacggaaacactgaaaatatcacttgaagataggcacagcctgtctggtttcttttatggtttttcagattccaaacggaagaaaaagatatataaacactacttccttgggtggcagatcaaataaaggacagttttgtttttgttttgttttgttttgttattcttgcaaaagctcttagtgaggtagaacaaaataaaagatggtttaaaacaagagaatcacatttatattgcttggctgtcttatttgtaggaaagaagataaattctttacagataggtaacagcactacccggtgctgactatttgagtgggatatatttccagttcattaaaataagcaaaggtgatttaaaaaccttcaacttcttgtacagtcacacttatcaacctaggttaattgggagaaaggccatatttctctctgaggtttaaaaaagtgttgtttcattcatttattcgctcactcattcattcaccccctcttcaaattcataaaacatcagttcgtgcaaggctatgattctaactaacgtactgaaaataacttaaggggccgggcacggtggctcacgcctgtaatcccagcacactgggaggtcagggtgggcagatcatgaggtcagaagttcgagaccagcctgaccaacatggtgaaaccccgtctctactaaaaatacaaaaattagccaggtgtggtggcacacatctgtaatcccagctactcaagaggttgaggcaggagaatcgcttgaacccgggaggcggaggttgcagtgagccaagatcacgccactgcactccagcctgggcaacagaacacgactccatctaaaaaaaaaaaaaaagtacaaaaattttctgggcgtggttgcatgcacctgtaatcccagctacacaggaggctgaggcaggagaattgttggaacctgggaggcagaggttgcagtgagctgagaccttgctacccctgcactccagcttgggtgacagagtgagactctgtccggaaaaaaaaaaaaaagaaaagaaaaaaaaataactcaagtaacaataactaagagtatatactaattatttaattcattaatcaatttgttcatttttattgcctattatgatgtataattccaagtttctcaaacctaaaccaaaaatatgaagcaaatttgtagtgcaacctggaagcttctctccctgcactctaattctgatatgttggtgcagctctgcttagttcaaacatgttctgggagctgaggtatttaatatagttcatgctttaaataccagataggttgggaaacactttcatttgaaaatttatgtgaatatataaactgatctgttaatacaccaatttatttatgcaaatgtgtatttgtggcccttaaagtcaattttcttaaatagaaatagttttaggcagtttatgtaaaacgttgattttctcatccatttgcacttacattaacttctgtatggtgacacaataaagatagctatttgttacttggtaggttagcacctgtcatcaatatttggagcactgcctataaaaccagacttagataagggtcaaggaagctatctacacttggtgcctacaatattaagtttttctgtatcaatctaatttccagattacatttctttttttttcatacagtttaacgtctgatgcccgctatctgtgttattgagagtgtgcatgtgtgtgtgtgtgcgtgtgtgtgtgtgtgtgtgtgtgtgtgtgttgccaggaagtagaataaaggactatattcgtatcagagcacttaggacatcactgtggagattggtttattccttcagcctcagtatccttatccgaaaaatgtacataattacacatagggttgtcataagggttaaagtcactctttttcaacaaatttttattgagcacctccttaatatcagacactattctaagtactggaaatacaacagtgaacaaaacaaaatattgcataaatgacaatgtgcattcttagcattgtgctaataaattaatcttcaattattagtgcaattggtgttgttgttgaggtagtggttggtagcagtagtagtagcagcagcagtggttcagtaatacttactgactcctgtaccagactggatatttcctgacacactgatatgaactcctaataaatagtgcctactaaatacctggcatggagaagagatgcacatatttgttgaattgaagcattgactatatgttttcatgcatatttttgtaattaacaaatgaaagaaaggcagaaagaggactaggatgaggaccatgtgatggaattactcagcctgcttatttctcacaaggaatgaggggatagggatataggaggagattggtggcatcgatgtctaatattatttggcaaataaatcaatgatgggttctaactctatctttacaacaaacctatgacgcaagaggaagagagaaagtaagtcgcatgcccgaagtcaagcagctagtactgcaatgaattcagaaaagaatcaggcctgttactctccgaaggcctttctctttctttatcctctgaagtaaagctgaggactgctttttgggtgaactaacacttaggagttgagagtttcagaaaaagggcttgcaatgtcatgtcctattgccactgaagaagaaaaaggcacaccaacttcacactcagctactccaagttcagtttcaattaaacataaagagacagctgggccgggcacgttggctcacacctgtaatcccagcactttgggaggccgaggtgggcggatcacgaggtcaggagttagagaccagcctggccaacatggtgaaaccccatctctactaaaaatacaaaaaattagccaggtgtggtgacaggcgcctgttcttccagctacttgggaggctgaggcaggagaaatcacttgaacccaggaagtggaggttgcggtgagccaagatcgcaccagcgcactccagcctggtgacagagtgagactctgtctcaaaaaaaaaaaaaaaaaaaaagacagctgtggtttcaggctggaaccactggagccagaggggcctctagaaaggcctggactccatggccagagggaaggagtttcacaaacaggattttgatagcactttagccaacagttctttggtgttctaatactgcttgagaatggttttgatgtctcataaggggttacatagtgagttatctgaaatcatttctgtctcaaactgtccagtctcccttacggtgctttagtcaactcttcgtcttctcagtcttcatgttaaaaggaaaaatcttagtgaaatctactacaggagaccagctaatttcttgaacaatagtgaccattttggtgagaggcctttaatagcggtattgagaaggcaaaccttcaattagaactgaaaaagttgtctttttttttagcaggaaactggtaaagggggtatctttgcacaaaagcagtcatatcagcaggagacattgtaaaattaaccagtcaagatacctttcaaaggtaactattaagaaagggaaaccatgtaacacccacctttcagcaattttttctgtaacattttattaagtatcttttcttaaacaaatgcaaagtgtattttacttcacataaatttgacattcatttcatcgttcattttgtgtctagtatgtaagaaattatattcaattctgttgaggatttagagaagagagagacacagcttatgccccacaggtacataaagtttagatacgaagacaattgatatacacccatcaaaatagtagtaatcaaaggaaaggaagaggaagaaacaggtatttcttgaagacctactgagtacctgccagatacttattattgttttcattttaaacaggaaacagaagtttagatgggttgtgacatttgcccacgttcacacaggtatagatttagagataagactcaaattcaattctgtctcctcccagagccagcactgtgttcactaagccccctgactcacacacatgacacagggatctggagatctctgctgaggtgttgaagctttgaggaagagatagcattttatacatgcattggagatcaagttgtaacaaatggaattttagtacatagttattccagatcatcatcttatggattgagggggtaaatgaaggagcatgtgagtcttccttggtttttccctgaagtatttgggaaactgaaggcaaaaaaaatccaaagtccaaagcgtgcgtaagagtcgttgccacttttgagagaataagtctgtagatacctttttacctccttcggtcaatgaataagtgctactgagtaaacttacattattttctattttacaaattacactatcaatattacttggaaatcctgttgcctatgtatttctacacagatcaaagcttttcctgtggtcggaatgctctgattgaatccacaaatcttactagttgaatcaaaatcaacggcttaaatgtcaggatctctatctgaggagctgtagacccctgttgaggttttttttgtgtgtgttgttgtttgtttgttttttaccaaagtcccccgaaagatgaagagggcattgtcttgtaaaaggagggacgtgggaagatctgactagaagaaaaacatgtgtcataaaaattactgaatgctattagactatataaaagtcagttcttaaaagtcccttagcaaaaaagcacatttgtggacaacaagctgttcactttgattgatgtgtgatatacacataggagtatgtgttagattaactggaggcacattagggaggacatgaatgtcaggatgaagaagttggagtaactgggaataatttgattattttgagcagagaagataatcattgcagctgtgctttagaaagaccatctgtgagtcatgtgtaggacggattatagaaaagagtgaagacacagcaaccagccaggagactgttgtaaaccttcaagcaaagatagcaaaatttcagattaaatcagtggtgatgaaaaagaagagcttgagttggattctaataaatactcattggaaatgagtattccatttccatgtaaatggacagtaggctacaagtagcggataaagcagaagaaagcatcaaacacgcctcctagtacttgagcttgagaaattcagcttggtttgagtttgcatatagtgaatatttaaaaataaaagtagcttgtactctttcacataggaattacaggatgtagtcactatggaaggtcagttcactgtcttttaagaggcttctctcagtagcattgctttttctggtgaattcagcataaagactaggcttagaaattgactttgtctggaaattaaaggcatatcattttttcaggggtgacttcacattaaaaactatcataagacatataaaattagaatgcaaaattagtacattataataaaaaataattaatggccgaatatgaatatgtttagcttccattcttactttaagcataccttcatgggaaattacatcacataaatcaaaaacaggatgttctttgatgaacaaggaatcaacaatgaaagttggatgggtcaaatatttaacaacagccaggaacatccatctgccaacagaaattctgtttttaaaaacagaatatttagcattctctaatgcagtctactgcattaagtcaggtttgcatgataacctgacttttcattatgacttttttttggttctttatttaactgaccatcagatttaatatgttaatgaatgtaaataaaatgcatcaagagtatagtaaattcttttgagagtgggcagttttctaactctttaaggtatcattttgtatcttgattcattaaagttgactgtacaatttaattctgagtacagtggtgtcttttattttgcaatctacctcactgtataacccacatattaacaggagctttatagaatctgaggggctggcaggatataaagatatacattaatcaaggcaactattgttagtttgtagtaaatagtcctaaaataccactgtcttactacaacaaaggtttctttcttatacttatcacagtctaatgagggtttgttagttctccattgactctctcccattcttcacctaggggtgttcctggaggctgccctgattagctctcatcagtgggctcctttgccctctaacttctgatttggctcagtcagtggaggacaaccactgtatatgactgaagagcaagagaggggatttagctgcagtgtttatttctgcagtgtttcctttactggcagcatgttcctattaaaaggaaattctccagtcaagtggcattcgctgtacaactctctctgtgttctggaatctagtttcttcatttgttttctcaggcctaggagtagtaatatctctccaccattactagccctgggggtattacatcattcttcattgctaggtataaaatttgtcctcacctatataagagatgtcctgtaaatctcttctcaatttctcaacttgggtgtgccatatgctgtctacttgaactttgacatgtattctcaaaacagtgaagtggctatttaagctccttctttcttgtgatgctatcattttaaacacatgctctctaaggttgctgcagaagtggagacagagtgaggatgtttgcacaaggttttgtgcttagtcctaaacatggaagacattgctgcctatatgtcacatggctccaacataactgaagtggggttttctcatagactcagacaagttgggaaataatgggatttggtgagcatttggtattgtttgtgtcgtacatggagatatgcaataagcaaatggaaatgtggacattaactcaaaaggaaggatgatattaaatacataggagaactttagatggcacttgaatgttataccaattcaaccccatcatcagttttgaccacatctttccatttcttaaacatacttcgttcccactacagatgccatcttggttccttctctacctctattttgatattcacatagaccagtactacagatttcagttatgtggttcttctgggttccatctgtttcttttcattgtaactaacagaagcctggtctgatttgctaggtgaagctgtacaagtgaaagagaaatgttggagagatgtttcatggagaaaagatagccagacagactccagattacgtccacgaatatagaagcaagaagagaactcagtaagaggtatatgaatcaggctcagtaagaggtatatgaatcaggacaatatcatcaaagacagtccaggaaggaggttcaaaaaagaagacatggacagaagtaccaaattcagggatatgtgagaggacatgtggaaaagagctctggatattcatgctcacagtcttcaccaatagtggactgaaggaaaagatgtcattgaaggctgtacagccaccacaaagaggagggagtttcagtgcaaagagggcatgcatttctttcatcttcatccttacttctttccgaacttcaattctttgaacagtctacttgctacctgcctgaatcctttcttaatcttcttcacatgtactccttcaactccagaaataggttttctgccttttctttgttaggatcacatttcatttatgttctttaatccaagtcagttcccaatcattgcttaacaagacttggcttcttattgattctctagttcagttgcaatggtctattccaaatcttctccaaacaccttaagctgccatccaccatataggccttactcaatgatgctctacttttcttccttctacctaagacaactttgctttgacacctctgtaggcctaagaaagtggcctgcaaatatgttgctattcactcttctcacctcccaaaataccaccttaatctctcctgcttaatttgcatcttcaaatatttagtttctctcttattgcttacccctttgtctcaggatctaagaacaggtttagaacagataactgaaatctccatgacctcctttagataatacctttggtctcttccccaccagagtctgacaatttactaaacaaatgaccgttctcattggtttaatagccagttcttttcattttcccctgctgcccctctgcaggaattactaataagctgcagacttgggcagtagcaggcagtagggatggctagaggtgaacagtggcaggcagacccttctgatcctcaagcagcctgcctggaagtgagcatgttgcaggaatagtagtgttatctcttgagatagatttctcttgtgtcttctaatctccccccaatgccagtgttatgtgtgtgaaccacccttgaaaaccatcttctgctttccatttggctttccctttgggctggctgtaatatttgcttgctttcctatgtcaggactctttgaatgtatacctgtatcttgtagctatctcagggacctttacaccaagctacatattaaaatagttttctctatttagtaattctatgtttcttctttatcaggatattccttctcacttttatccccaaaatggaagaaataacacgttttaaaaattaattgcatagcacatttgcaagttatgttcccgtacttagtccagtttaagcctcacgccaaacttatgaggttgatattcttacttctatggtacagacaaattaattgaggcaagaagcagctcaggcccttgtctagttgactgctgtgactcatactttctgttcttggctgctgagtcccttgctccacatttctgctttcctaattgtttttgacacaaggaaatgagaacatgttggaaaaacaatagtctttctggatgagttgttgggctaagtgacctttaaggtatgttctaatctagaggtctttggttcttgcttgattatagtgcagtactattagacaatcaatgcaattgtcctagctgaatgacagggtagcagagacagtgaaatattatttttggcacttttttagtgttatctatttttgtcgatagaaaaataaatcccaaaatccaaagggaaaatatatatttatttgcacttagtgttcagtagtgaagtgcacgggtcatttgttagtggatgaatgtgggcaagttactttacctgtccatgatataactccttatgcataacgtgggatgaataacatgtctactcatagagtttttctgaggttcaaattagtgtacacatgtaaagtgtttataatggtgcctagcacttagtaagtcatcagttaatatcagctgctgttacattttgtaaaaatagtaaagccgtgtgtagcggtccgttctcacgctgctatgaagaaatacccaagcctggctaatttataaaggaaagaggtttaattgactcacaattccacatggctgggaaggctcaggaaacacacaatcatggcgaaaggggaagcgggcatagaccttcttcatatggtggcaggaaagagaagagtgaatgagtgaagggggaagagccccttataaaaccattggatctcatgagaagtcactagcacaagaacggcatggggagaaactgcccccatgattcaattacctccacctggtgtctcccttgacagtggggattatggggattacaatttaagatgagattttggttgggcacacagccaaaccatattactgtgtaaagaacttaccacttttaagaatagttaatattaattgacatacagtatctgaccatttattacttggaaaactctatctgcactatctcatttgacctaaattatcaggtagaaacaattatgatcacaatttaaaagatgagaaaactgaaatatagggaagttttttaacttaagtctcatcgatataaattatatgaaatgatttaaaaaggtgtgtctgaggagaggcagcataactaattagcataactaatatgcgaagcctttctggactcagttttggactatgtaacaattacacaaaattggaagccttttaaatgcctttgggaataataaataaagagttgcacctggatttcatttttaccgtaatcaaatgttttatattaggtattttggaaaactactggaatgaccagcaagattataataataattctggagccactttactattattgtctcatttatacctctcagcagaggctggagcacatggggactatgccattcccataaccatatgttttaccaccttgctctttgtcctgtagatgagcaagcaaagaagcatacaaagagcatcctataaaagagcacgaacaaagacaatgtttgaggagctctgttctttggtcttcccagagtaaatatcagcaatagtaggaaaaagtgtttaaaacacgtatgaggggaaaaaaaaaaactacaggaacgtcaattacaaatgattattttcaaaaataaaaccttctagcttttaactagtttatcgcagagctaaaccaatacagtttcatgcctcataacaatttaataaatattactaaaatatggcaactgctaccatggctcattagcaagctgttggtgtaatataaagttatccagaattgttttgggtagttggtttgtcaatataatgcacacagtaatctctgaagaaagtcaggaacatatggtccatgttcatcagctaaccccaggggactgcaccagaatctctcttcttacaactacatgacgttgagaggagagcttgagagaagatagggaaaaaaagaatgggtggaaagagaaacattgattactcaaaccataaaatcacacttgcaagcataaatcaagaatcacaaagctaacatcttcaaggaatctgttaaaatacaagttgaacattgtagcatcagaaattctcagaatatgaattctgaatcttgcttggcacacagctaaagttaatcatttcagcagcagcagtaaaatgctgcatatagcatgctactggccaacataaatgaatctaatgccatctatttaccaaaatcaagattcctttgaatatattttcaataatttatatgctaagatgtacatacatattacactctctctctcaaaagaaacgtcatattttctaatttaaagagacatatcttgtccaattaaattcgtttgagtaggaaactgtagagttaacaactgtcaatgatcatctatgtataagtagaattatacactttaaagattatgtttatttaataaccatccctatttcctgtaactgggcaatcagacatttttttgacccaaaatatgaccactgcattttgataactctaacagcacaagatgaggtctggctattagagccatataatgatgggtaagtattttgttttcttgggtgctttcacagtgtaaatattatctcagaagtgggtttttagggcaattcaagtaggatgcttaggaatgtacttttctttatttggaaaattttctcagatttcatttgctcagttttatacctattgatctttcattttaattttatctaaaaacctttcagttttgcagtgtgtcacaagtctgtgtaagctgcagcttcagccatctcttccatgcaatgtcaatcttgggtcgtgtgaagcatgtggctttttggaaattttctaagtaatgtaattgatgcaaaaaaatcaaggatatatattttcaatagccaagataatagatacataatcctttcaattaaaatttgtgttaattcaaggaagggtaggatcagcatatatattatgtgtttatcaagaatactctcctgagaaaattcatgaaatgagaagtaacagggagaaagttgaaacattgctataacatatcaaaatgagaggctctgcataaatgaatttataagaaaacattaaaattgccaagtataaagactttacagatacagagttaatattacctttatgtagacatttgaggcttggccaggctctcctcaatgagtctattttaaggtaaagttattaaagtccggctcccatctcacagatattatttgaagttgttttatgtggaagcagcctgcctcatgtgattgcactgtgaagctctccagctagaaggcggctatgtgacttgaaatttaaatataaagcaaattcagtcaggtgccaaggtgccagcctgctggaccaccatattgggaggaaggagaagtggagggcagggggttgaatggagattgggttgtgcgaaagagaagatttcaaactttggggctggaagagcacagggtgctgcaagaagcaatgtgttgggctgaataattcatgatgcagtactaattttgactctggagaaaattgctttctcactgtgccaaaagctaggcagtgagaccaaaaatcaaagaggaagctaaatggaggggagaaaacaccctaaatcaacaccatatcaaattgacaaactgtttaaggctgcaaaatgtattgtcaaaacatgtgagtagatattttaaaccttacctaaaattgagcatatttatgcctacttattttgagcaataataggtagatattaaataattattttcaaaagtagctccttgatattaatgcagagagttccagtaaggaagtaagcatttgcatttcattggaacttggtaaaaaaaaaaaaaaaggctgcatatcttggtatagtgtaagagatccatcatcattttgtacttacagaatcatatgggtgccagaaatgaccttttgagctaattaacagagctgccataaatatggaacttgataaatgttaatatttattggattcctaaaatccagatggtcttccttgtcttttcattctctttggaagataatattaaaataagaaccttctaaaatgcaaccttaggcatcttttcaaagtctcatttaattcttttctttaatggttaggaggacttatgagcatttctgaggaaaagtcgctgactgcctcttaagccttaaccaagctttaaactttagggatttccactcagatttaacaacattgagaattttggtcctagatttctttttctttaaagagttctttaaagagttaaagaaacttctgggcaggaaaatacaggaagcttagaatgaagatggttgaggtgttgtcttcctcctcttctttcattttgtttgttttgctttcaagagaaaagccagatacagctctggggagtcgaaaggcatccttggcaaagaatgcaatccctccagaggctgaataagcgtgcacaggatgaactcacagatagccacgccagtctcccagagcagagctgcatttccaaaaattcactttctggcaaagatgaggattttcctgtagtggtttgcattgctgaatggggctgaagaaacaccagtcttcaggactatttggaaattatagttaacaaaatctagagagccatgagcaatccaaagtaaaattcagttgagtgtgtagagccttccacatgagagggcatggtatgtaatttgcttcacttaatacagattttggagacagggcagcaggctggtgcacagggcatattttagagggaccataacacacccctatactagaaatgcagtgtactgtgtctcctcactagaaacctaaatacagcctctgaaaggcttgtcccttgggtgacaaagattgctgaggtttgatggagtgctgtgctctcagtatggagtagggggtggtggaaacaggaggcatatattttagttctaggacctccctacatttacgagttctttgactttggaccaagtcatttcagtttgcttggctttcttttcctcatatgtaaaatgatcattttatgttagtttgaaccatgggaaatagctgatatttgactaacctataaaaacagcaatttcacatggttcaaactaataaatgctcttgagacttgttctgaggagcaaagaagcacctcgttgtagataaacacatgcatgtaaattgtgtcctcttcctgctccagttacatcatctattgaacattttgtggagtttcaatgagataatatttggaaagcaaatagtagcactcaataaaagtcagtttctctcatcatgattccacacactttaatttcaactactgttttgaacttaacacttctccagtgttttacaatttacaaagtgctttcgcataagttaactgtttatgtgatttttgcaacccagtgataagacaatgaaagttccaaaaaagttgtcacttggactgaattatccagataggtagtaggatattgcacgtcgctgagtacaacatatggtcattgcccaataccgatgtctctaaattaataaaggcaaagtgggcatgtaggcatgtcactatctagtctactaatcagaaacagatcagtggtctttaaatattttgatcacacaactttttatgtgataatatttgaaacattaatatatgtgccatttatctatttagtatacattttcagtctctataaattatatatgcatggcagatgtaacatctgatgtgcattatgaaacatacgtaagtaaaaccttttaaaggaaaatatttaaaaagtaaatatattgcaagtcctaatattttctccctgcattccaaaggattgcacaattgcagctttttaaattgagatgcaattagcacagactggtggatttctatggtctttattgcccaggccctactttcggttcccaggaacaagaaagttttgggatttgtgatcaagtcagaccagcttccaagcttagtgaagctagaacataagcatgcagcttataagggaggacccaggtagagtggtaatgagagccttacttgtagtcagagcacttactatccaaaactgtggcctcatgcagggcacaagcaccctcaacctcaatttctaatacgggtttatttgaggagtagaaaagaataaaatacaggttgaacatctgtaatctgaaaatctaaatctgaaatttttcaaaactataaactttttgagttctggcatgatatcacaagttgaaaatcccacatctgacctcatagtcaaaacacagtcaaaactttgtttcatgcacaataaatattacataaaattatcttctagattttgtgtataaggtggatatgaaacaaaagtgaattctgtgtttagacttcagtctcatcctcaagatattatgtatgtgtatatattccaaaattcaaaaggaaatccaaaatctgaaacacttgtactctgaagcatgttagataaatgatatggaacctcaacctgtattctattgaaagcacttgctaatctataatatactataaaatataaggtattatcaatgtgtttatgtttactgtgtatcccagcattttaaatactgtaggcacacagcatgagtttaatgaatgaatgagcaaaaacattaattaattaaaaataatacattaccttactatgtcacatatgctatttccagaaacagaagacacaacaaaatatgttttcaaagcaagtttttttgttttgttatcattttatataataggaatctggaggtaagtagcaccagagtcggcttattcgactgctcaaacccattggtaagaaccctggttctgtctgtcttccactgagccacgtggaggcactgggctctttctctttggctagatctactgaatttctcagacgctgccacagttccaagcagctatgaagatggcagtgtctggaggcattggaaagggaacattctgttctgacaaagtgtttttttaaaagaaaagaggccaaatattcactgagactcccttccccttaggctcagtggctggtagtatgtcgtagcccattatttcactagtccaggacaaaagcaatgatgctaataggatttctttatcttgagtttcatgtcttagggttggagaagggaccaagcctcccctgaaagctgaggggtttatggtcaagaagaaagagtaactatggccacctttaggtcaccagccaataatactgcttctctatcctgttctgctgtgacatttgtcccagcaggtgttccagtctgtcctacagtagtgagaccacctgatatggtgaggaaggcaggtaattgatcttactccatcatatcatcacatctatttccaccccccgcccttggagacaaggtctcactccatcatttaggccggaatgcagtggtgcaatcatagctcattgtagtctcaaacacctgggcccaagtgatcctcactgtagtctcccaagtagctaggactacaggcacatgccaccacacctggctaattaaaaaaaattttttttgcacagagatgggggtcttgatatgttgcccaggctggtctggaactcctggccacaagtgatcctcccacctcagcctcccaaagcactgggattactgttgtgagccaccatgaccagccccatcacttcttttgtaggtttgtatttgtttttatttttgacaaagacttttatttcacggtgacttcttcacaagtttcctcagatgctagtctgaacaaaggagagcagggaactagaaatgtagactttctgttttttccagctatggcatcactgatctcatccatcttactaaagtttgtgcagtcttgatcattccccattcccccaacatgatggcaaataccagttaagtactcatatctaaagaaatcctttattaacaggaagttaattaagaacatgtacatctctgacattcatcattacaatgagtagaaattaattttttcaatttcagttaaattttattcagcaaaaagctttaacctcttataataagatgtgaagaattatgagaaattatttgctgtatttctggaacgaatgcatttaataataggtcagatgagcaaaaatggttgtaattcaaatttgaatagagaatttcttcggtgatagcaaatggaacaatatggcttttataagtaatattttgattttaaattatttaaaatattcagatgctattctagttttaatccactttttgctttctttcccagcatcctctgaaagtttatatgctagaggtctctccttcagccactccttgatcatctccaattagaaatctatttatttttcatcagaaatgatcaatgctacaagtctgattaatatgagtggtgtgtatatgtgtgtgtgtgcacatgaattttagacagttttctgcagaatcatcttctgttactatttttcaagacaatactatgacaagccaatgtgttctgaataaattatgcaatcgatgggtgaagcaggcatttgctttccagtattatacatcccaacttgtatcacacaggcagacttctgttgacaacactattgacctatatatgaaactttgaaactctgttttacatttacaaaatttgatatttctgatattctatgggcttcactttttgacatcatgcctttgtacttttatgcaatttgataattatattcagccctttataaatagttaaaataatgtttaatcatctatggtaaatgtgtaaattccttactacacactttctgattttgtgtgtgatttgtcaggaaaaattcgtggtttgtttatattttttatgttttccttttttttttttttttttttttgagacagaatttctctcttttgcccaggctggagtgcaatggcgcgatctcggctcactgcaacctccgcctcccaggttcaagcgattctcctgcctcagcctcccaagtagagtagctaggattacaggcacacactgcacactgccactactggctaatttttggtatttttagcagagacagggtttcaccatgttggccaggctggtcttgaactcctgacctcaggtgatccacctgcctcggcctcccaaagtgctgggattacatgcacgaaccactgcgcctggcctttttttttatgttttctacacaagaccagattatattttttagaactaaggaaaaggagcacttagaaagtgtggaaaatcaatgaccttgcaatttgatatatactctggagtatactctgaaatctcaatagtttacagacaagatagtagaaattagaaaatacattttatatatatgtgtgtgtgtgtgtgtgtgtgtatgtgtctctatctatacatatacacacacatatatgcacatatatgtgtgtgtgtacacatatgtatacatatgtatgtatatatctgggtgtgtgtgtgtgtgtgtgtgtatagatatatatagatatatatatatatatacccttgtgctaagggatatattttctaatatgtattcatgtatttttataaatcttaaattttcttcagtctcatagctacagactctgtaatgttttttgttaaactgaaaataatcatctctggtgaatctttctaaactgtgtatttctaaatgtttttaccagtattattgtgtttttggaatcacattactttttagtgtagtgatagcaagtatagcgagttaatgctttttttaaattagcaaattaatgtgaagatcagatctcaaatatcaggttgtctgatcttattcagtatgccatttggcttaagaagttctcattttgtttctgcagttcactcatactgagcaaatctagacaaaacaaatcctgttgctcacttggaatttagataattgtttcacaattcaaagaaagaagttaattagcatgactttttttcaattaaaagttatttattaaattttctttcctgaaactgttcatttcctaggaaggtctagaatggaacaaatataaaactaagaaacagcagcttttactccatgtgacaaggttttgttgagggtgcctgtggggctggccatatttgtcatgtgtgtaatgtggctgtgcctctggcaagctgtaagctggtagttagtgtggagtctgcattccagctacctgggtgccatcgctcttaacacacttcttagctcagatgttccaatatttgttctcctgacctacaacattaggaccacgtgggaacttgctagattctgaggctccctcccagactttctaaattagatactctgagggtgaggcccagaatctgtgttttaatgtgctcttgaggttattctgattccacctaatgcttgagaagcactgccctagcttctgtcttgggcaacactcctgaatcagtgcctagcttttcccagctgtaaaatgtaaaatacaacatttttctcgtagaattattgtgataattcaagaaaatcatgtaaagttatttctgcaatagttgcctaacagatagagtgctctaaggacactgagcgttcttcaaaagcagtatggcctgtgtgctcccatgtctgagcacatttgaaaaccagcctctaaaattacacttcctcctctatcaatgattgcagaatcgaatgttgcaaatgcatggcagtaatacatcctttgaagaatgaagtgttattaaaatttcattccataatatttgtattagttttgtattactcaaaaggcctatcttattttactttcttaatgaaattaatttttatttcactatgaatatttttttctagcccctactttcatttccaaattttctcattttctttttagtctggatatttcctagataatttatttcaacattctagtactgtataatctcaaatacccaaagaaaatacattttttgaaatattgatgaactaaaaccaataggtatgaatgagtcgatcctgtgtttaatctacatgtgagatatcacctattctattccatgcaaataggaaggtaaatatgatgaagtcattaataataacgaaataaggctattttatataagaatttaggttatgtcccatacaaattaacagcataatattacgtgattagtcttcctgatactaatattttcctaatttattcttttcaccagctgcattaaaattcaccgcaaagattcagtccaaggttctcacagggaactaaaggttaaaatgtgtttgttagccaatatacaagactctgtaatcttatatactacattggcagggactgttgggattcagttctgttcagccatggaggacacactctgtgttgccctgagactgtggaaaatacagcgtctataacatatccccttcttacagaggtatgcatctttgaactcagaactctcctttgctactctcattcaagacactgtacagcccagaacttccagcctgtgggtttttctcaccccctttctctgcctgagccctctgctcagggtgggattttcatgatctccccacatatctttcttcttctgtctctgcttttcctctcttcccaaagctagaaagccatctcctagcttaattaccacctcccatgatcttgtctatttgttgctattaatctgaccttaataaaagtgtttcctgagatttcaccttatggacatttggattcaaagtaagggctagaaatggagagttagacgaaggatagatgagctgattgcatctagggaagtcaaggagttgggcttgcattgcagagaatggctaagaaaggagaccaatctatgggatacttaaaaaacctattaaatctgaatatctgagtttgtccattattagaattctttcactaagtgcttcttaaaatgatcaaagaaacgtttgggattgtgagaaaaacagaaacattgtcctgtgcatatattaagtgtgctatatcaaataatatttcatctttagccatcagtaacacatttgttcttagtatatatatgtcaatctaaaaagggtttctcaaccttaacattattaaatttttaggttaaatattgttttgtttgggtgtgggccgccctggcattgcagcttctctagcctctacatactagatgctggtagctatgtgacccctcaaaaaaattttttggcaataaaaaatatcttcagacattgtcagatgtcttctggggggcgtagtcatccaaactcgagattcgctggtccagactgtaaaaattatcaaactactcttgggaaagatgaatctattttaagatccacttgcaagctacatctacataaatgtccattaacctttagtactttgtgacctgattttgtgtttcttcttgcatgattattttttgggccctcaatatatatttgttaattctatttcttcagtttctctagatgctttatctggccaaatagtgtatcatagcaaattagttctagaacctcacttgtcttaatattagttaattggaattaatatttgttaattctatttctttcatttttctagatgccttatctcgccaaatagtgtatcctggcaaattagttctagattctcaatagtcttattattcgtaggtacacaatagtccaatgcattaaaatgactttccttttaatagttctacgtgaataaaaatgtatttcctggcaaatttcacctcaatgctgcaaatccattgaaaaagggaataatacagtatcacgatacagggagaaaaacttagaaacacaataagatatacatacacacaactttacgagagtaaataataagtaaagatatatatgtatacacacacacatatactgatacagatcactgcaagaaaatcacaaataccaaagtcaaccagaagacgtgagtagagaaaaatagacaacaaaacaacaaataatgcaaattaaagtgagataatcattttgctgtcaagataggagaaaaaccaagagtgggaagatattatgattcttcaatcatgtgggcatgtatctttactgtgtgtgtgtgtgtgtgtgtgtgtttatctgctgagggcctttgaatactctttccttgctcagaacaaatagacaaatatataattaaggcacctaacaatacagaccatattttcagggatatagcaactaaaaggtcttaggaaggccaactcaaatccaagcacatggattccagctggggacaggagtgaaaggagtggatttcttgtgtctgtgagcctagagtgaaaaacagcttcaggaaaccttcactttgttatgtatgggatgaaattgaaatcaagtgtattgtgttagggggatcctacaggaagaagatctgggagatttttcttgaggtttgggggcaggcatttagctgagggtggacattgaggagaatctggagggcttttattagaaatatgcttccataccttgcaaaaaactccaaaatatcacacctgtttctcaataccacatgctttgtacatgccatataactatttttgattaccaaatttcattttgagttttgatactagttttaaaattacagttatagctgagcatcatagcctgtagtcctagctactagggagacagaggcaagaggcttacaacacaagcctggacaacatagtgaaatcctatctctacaaaaaaatatttaaaaattagtcaggaatgatgacttgtgcttgcagttccagctgcttcagaggattgcttgagcccaggagttggatgctgcagtgagctatgatcataccatcacatgccagcctgggtgacagaagaagacactattgtctcaaaaaataaaacaacagttgttcaggatcattaggaatatatttaatcaatgctttttcagaaatggtggtttaaaaataagtaggctaggaaggaagtcctaagtaggtattctggtctcagacttgtgcttcctgcaacacctttaatatctataaaataattagagtttttgattgtggagtaggcttgatttggaactgaggatttttttctagacatatattttaatttgagtttcactcactgccaaaaaaaaaaattggcaagacagagaaagaggaaaaaaaaaaaacaggccacaaaatgtaaaagtcaaaagcagtcattccaaatttgtgtcttatatattctctcagactttgctgtcttctttatgtttcaacatttttcagatagcatcattaatgaacagccttccagcccccctccataatgcagctttttgatcctagtgcccaactggcttcaatcaattcctctgaccatgcagtttatgactctacaaaacctgccaggactcgtttccttagtattagatgcaggcaggtagaaattgagagatgattccacataatgctcatcaaagcagaaaaaaatcaaacctaatgcacaacagggttacaaagagaaaaagttaagcagtctgtattaaaaacaaaaggaaataacagggacagaagaaaaagagaaaataaaacaagtgatttcatgtaggtgctatagaatctttaaccaaaccacaggctctgatgaatgatctcttctgcctgagactcaggactgtcatggtccttatgtccaggaaaagagccagctcttttattgagttgccaagagttgtcactgaagccatcctgaagtttccttgcttctagttagataggaagagaaacacaaatacattctccctcgggacggacacttccaaactaaccactcccatccagtggtaacctactcccaaatcctccaggtggcctactacaccctgctttcttctgcttgcagttgcctgacatgacattgctcaccctttcttcttgtaagtgttacctttttctgtgtccctttgttatagatgtttggcctatagtggaagggccttacatttgtgtcacataaatcatgtcatgttattcagcccattacattttatgtcaagtaataccttatggtattttacctttatcaatataaaacaaatttcttttgttttaagtttttgccctaaacttcaatattatctggtgatggagtggtaaacaggctcttcattcatggagcttataatctagtgtgagtaatagaatagaacaatttcttaaataaatcaggagttaacgccgattgtgatgagaactcaggagaagtgtaaggtatgttggaaacaaggagcataagttggatgagcgatttagacaagtattccatatgggacagacagttctgcctgtctgaaggacacaaaggatgtaccaaggttatgtttctagacccagttgattagacccctgggtttctgctcttgagacattgccagaggccaaattaggccaagtccctgggtgtgtttgcctcctgtagggcatttctaaaaccaattactaccttcagatcaagaacattttctcttataacatctcttgaattgtttgggttctccttttaagaataacaagtcatccctgcaagctctttattttctgttctctgtatccaccgtgttttccctatttttgtttctttgttcttttcttctgaattctaggtagacttaagttggtcttccaaattgttggcatcaatctggctcttcagtgccccaatgtggatttctagtatgattttccgtggtaattttctgtatgtcacatatactttttacatcctaatatgtggctttattttcctgtcctgttctcttcattttgcttttggctagcttgtatagaaacatgttatttttgcatttgtatggaagtcatgttgcttttgaattgtaacaaaattgaaattttcttctggatcctgcagtagattagcagaaaatcttctttttgagaaacttaagtatttcctctcaggatttcttcagttagcaattcactaggaaacagaacccgaaacaattctttcagtgtagattctttattgaaaggcaatgcatgggacagccagaacaaccctgtctactccaaaggggagaacagtcagacgtgcctgcagccagccccagcagctgcagctggaatgccggagagccaaccaagggtctagaacatggataaagctgagataatctcagggtgtgtgtgttactttgaatgtatcagagtacttaatttctcaaaaaaacatatcacaagacaggctgtctgttcatataggtaatagtctgcaccctagatctgtatttggaagaagcttttctacaactgcaggccaattgctattcctggtgggtatttactaactcacttctgcttcaccttggccgcttttccccctggcctatcaactcagttggagagaatcagaactggacattttgaacaatggaaaaaattgatttcctcctaaatatactactagggtttttgctgcctttgtgcactcagaatgcagtgtagtaatattccagcaaccaccccaaacacacacacacacacacacacacacacacacacacacacatacacaccacccacgttcttctggatgccccactaacatatacaggcacacacttcacagacacacactccacgtgttctgcctaatttcttggtattcttttctcttataaatgtagtcaactagcaggagggcaggaataccaaggaaaaggaaccagaattctggcgcttccagaaagcagcaccttagggctataggcacagctattattttttggccagatcacaacctgtaagagatacaaagtgagtctgtttccttttctacataacctctgtcttatcatgacagaaaatgttgccggattctgggccaaagtatgaaacagcatcagaaaagccagttgtgtcatctatccagggatgccaccatgtgagaacaaggtcccctaatattctagagtgcctggcctccatgcagggacaattgtgtatttatttacaagaatgtgagcaccaacactgcagagtttaggcatttatgttcattgccgtatcctcagcacttacaacagagcctggattctaggaggtggctaatactttattttggtgaaatatttgattagagcagttatgtgattattggctgtcttcccctagactaggagttccctgaaggcagcactatactcttttctttgccaggttatcttctgcttcaggtacagcatctagaacataaaaagtaaatacatatcattttatgaataaaaaagcacttttagaatgcagaaagcagaatgactagtagtatagctgtgttcatgtctgcccctcaaataaactaagtgacctgacgatagtgactcttgtattcatctttgaacttctgacaaacccagcacaattcttttaagtaagtccttgcttactaattatttggttgaataagcaaacaaatggaaacatccataatattagcaaatatgatgcaagacatgaaaagccttatgcattgaaatctacatgacttaaccctagaaggctgaagtgataccacaccaggaaaattactaacttaacagaacacatcaaaataaaacattgttcaaatctatataattatctcaattgccaaaaaagtatctgataaaaattcaatagctattcatcataagcacagtaaaaatcataggaaagagggtttcttttttcacaggggaaaaattaaatgtttcaacaagcattacctttaatgtagaaatatgagactttctaaaacaaacaagaataatatgaacatagctcactttaccattgctgctacaattatttattattttaatagtaaaattattaaatattaaggaaaagaatattaaaaataaaatcaccagacctcacaatattcagtatacttttaaaaatgaacttgcaggaaaattgttgtttcaaatgtgtttactaggaagaaaaaaatgcaattatgtaggattatgattaagaccacaaaagataagtaaaaatgatacattaaatgctaatgtggggaaatagaagacaaaagagatgcatgttaaaaaattacaagttctaactacggtattaacacctaaaatcagttgaatatcatttgcaaggaaagaatatcgtttctttaaaaaacatatgctactttttctgttattaccactagaagctacattaattagacactgacatataataggatagactctaagtataaattatttctcatgcacatagcaccttgattggtagatattattgtcttctttcttccaggtaaaagtagagggtgagaggatgctcagcaggtggaggaaatataccaagccagggcacaggtttggttctgaatgaagggcatgttaccctacaacagtatgaacaagaaaacatgagtaacacaaaagcactagatgaacatatacacaagcgaacatcctcacacacaaacatctagtacaaataattaaactcagagtaattatcagtgtgattatgagaaagagataactcatgtcccacacagatgtaattaactatgtgcaaggcattgagtaaggtcttaggatattcctcaggtttggaatccccttcctgcattttcacttgttaaaataaaatcaccaaggaatatttacagtggaatatttgagagaaagtttgtatatagtttatttagtgttatttgtgttttaattctactttagtgttttgttgaagtatattaagatcacgtggcatatttctgtcataatgtcatttagtaagctctctccatacccgtttcttctacgttattaattttcttgtcgagacttgtattacttttttattgttgtttgttccacttaaaatagggccattttagtatctccaaaaacaatactatttctaattttcttacattttaccccaagaatctatccatatattactcaaaaaattgaaaaaaggcaaacttccaaacaacatgttaaggaaataaacacacttcagcatccagttttccctaaaggagaagcaattactcctgggatactaaatgagatttgtctgtggctcctctttgagaccagttttcctcaccagggatgacttattcatttgtacatcaaggaattctcagctttcttaccacttctagaagctggggacatttgatcatgtgtaggactccttacatttctgaaacacatctcagaaaagcaggtatagctaagccaacattttagaagtgcagaaaggcattttctggaggcacaccctccaatgctgcttttggagtccttgtgagattttgatttgaatcctccttctgtacctattagctatttgaacactgatgaggtactaaacctctatgaaccctaagtttttgtttattatattaaaaataatgctagcccttatatcctagaattgtgaggataattattagcaggtcatatgatagcaaatattgactgggttcttaacacacttcaggcattgtgcatgctatatgtttgaatccatctttgtatttaatgctaaccactctatgaaatagttgttatttatctccatttataactaggaaactgagattcaaattgctcatgtaatttggccaaagtctcacagttagttgtccagattcaaattccccatctattggactcatagtctctatacttccaggatggttttcacacctattcagtgctcaataattgtcagtcatcactgttgttattattgggagaactttgaaacacatttcccagaaactctcaattgacaaatgtggagccaagtctcttttcaagataggaaatttgtcttgtcttttctgtatatgtgctataacatattgcttgccttcttgtgaatccactaagagtcacatgttggcggtatgtatgacatgttcatgtctgtctcctttgtcaggtctctcatggtccagacatgagaaggtcatctttccttattcttcttcctcatttccacccactgcagcttgtacttgggctgtttgtatcttggtaagtgcaggagcgcttcagttcatcatcactgctgctttttcctctttccacatactggatcttgcattaatgactttaaatttggaaccattcattctactgtggctgttgggctttctctgtctttatagagtctcattgcaggaatacttactaagctcctgaaaactgacacacccttgcatttgacaactggctcattattattattattattattttattgtatcatttattgattttgaacttgatgctgggtttgattaagggaaaaaacttaaagggtttttcttttttaacttgcttatcttttgaccttatatctaatttcatctcatgacaaagaagagacatgaaatgtatttgaggtggtacactgatgattccatctgaatattgctttgtcattgttttgattagaaacaataaatggtgttgacaaactctgggaatgatttttataatgaaagagaatagtgaaagtggagaagtttcaataaatgatttttaaataaaatgcttttcttgaatataaaaaacatggtgttggcagatgacattgtaggaaatattactccaagatagactggtaagccttttaccctttccacttctctgtcacttcttgtctttctagaacatctcattactttcctttatgaattcttcccccaaggctctggtgttaggggcagccttcattttccatttcagttcaagggacttaccacttaatttaagtttcctcaagtctgaccctcaactccaaagttccactcatcatttcactttttagagcagagatcacctgcatgatagtgtacctattgatggtccctgatgtttcagaggcccctacttgtatattcagatgagaatatcaacagggccttcctcacataactgtaggaaaaggtcaaaacccagaccccatagagagacctgggacacttctaatttatgaatgcaatttttaaaaagatttaaaaattaaatgctatgacacaaaatacaatacaataggagtgagtgattcacaagatagtatgagtatatataaacataaatttatgtgggtgttgtagagttgaattcaagttcaaatttggggctttttgtaaatgtgagtcacagattaatttctgacatattgtacccctcattagggatacagcattatgataaatttctaagagaaaaataactaaatcacattgtggtcatgtttttagtgggaataaaacttaacctagaagagaaagcatgtaatgcttcattcaaatatgatattgatttgctgtgtggccatggataaacaacataacttcccaggacttttttcattttttttttattggggatagtattagttaccacattgaatgtaactggatatggtgtaaggacaaattaatttgtagatatgaaatatatttgaactataaaagacttttggacttaaaatggtaatgatgatacagccccctttcctcatgaaaattaatttaaaataactagaaggaaattcaacctttattgaaaagaatctttggccaaatactggaagaaaggctccagagcccagtatgccatttcagaagtagatggtatgcccttctgagaaaacaatctcttatttgcaacaatgcactctgtggcaagtgcatgcctggaagccactgaacgtgatgaagcaactggagggtcggaggctgagtcaggagacattgagacttaccacttgtatgaaaggagtcagacagtgaagcaagcttcaagggaaactccttcggaagcagtcctgagtgacatctctctctcgcctggggagaattaaaggctaaactagatataggaatacactttaatgcatttcatggtcagcctctgacaattactgttgtgctatatcccactctgaccctcctcccatagttccaagtactcactatattcaaaggtaaattaccagcatatagtctatgaagactcaccatgtgtaaaagggaccattgcagcataaataccaaggtattaaaataattagaatagaaagcagaatagaaagcagttgaaaaatattcaccagaaaaattttgtcatggagaaaatgaaattaattcccaaatgtattactaaattaagcaatagacattaacaaaacaataacttctttgaaataatgtctcaaagcagacatttgggaaacagaaattcaggaagaaatatagcaaggaaatagaaggaaatgactgttaagcagataaaacaagaaaattagtatattagtttgttctcatgctgctataaagaactacccaagactgggtaatttataaaggaaagaggtttaattgactcacagttctgcattgcttgggaggcctcaggaaacttacaatcatggcagaagaggaaacaaccatgtccttcttcacatggcagcaggagagagaagtgcagagcgaagcagggaaaagccccttataaaaccatcagatcttgtgagaactcactcagtagcacaagcacaacatgggggaaactgcccccatgatctaaccacctcccatgaggattacaattcaagttgagattttagttgaggacacaggcaaaccatattaagtataggaaagaatagtagaaaagaatgttacatccaaagttacattggaaataacctaaaggagaatagaaacggaaaatatcaaaaagcatgtgaacagtgaaaaaatgaaacaaaataaattaacagtgagttaaaacaattgtcaggatagatgaaaataatctgttagaaaatccaaacagaaaaaagaaaagttcagcatatgcataagtggtgtgcctgaaaaggagaaacgaatatatggagaaaaaaaatgtttaaagttactttttccagatgtgaagaagttttgagaataaacatttttgacttttaatcttttgtttggaagcccaacattatgaaaaaaattatgcaaaatgatcaccgtcaatatcctaatccacttaccttttaaaacacagtcatccgttggtatcttcaagagattagttccagggctcccagaagataccagaattcactgatgctcaggttctttggggtatgtattcagaaaccaccaatatagaaggccaactagaacagggaatcttttggggagtctgaaaggagatcaaatcctaaacaaagggtgacttcagaattcctctcagtaacattccacattaggaaaagaacaggtcaatgcctttccagtgttttcaggaaaaggcagtgtaacccatgttcctagactcagtgaatgtatcttttaaagtaaggcaactgacaaacagttttcaacatgaaatactgctcagaatctagttgccagattcctttaaaaatattctgacaatgaaaatgaatagaggaattacagcaaaagaactgttgataaacattaaatatgttgaaaatattaaatatttctatctgcattgataagtaaaaatatttctgagaattatgtttacagaacagaatgaaaatgttacaaagaataataacattgaaataatttatctgatacaatttaggatgaaaagtggaagagaaggtgagaggtggtatgcatatggtgaattcttcatcttttatagctgaaggcaaaaaaatgccactcaatggtgatttattaaataacatagcataaacatgcaaaggcataaaaatgtagtaaaagtgtgtaaacaattaaaattagataatgcagtaagagaagtgattggagactaagtggaggtataaattttgtcagtattacagtgaatggtcagtagataataaagaaatgtaggattataaatattatattggccaggcacagtggctcatgcctgtaatcccaggactttgggaggccgaggagggtggatcacctaaggtcaggagttcgagaccagcctggccaatatggtgaaaccccgtctctactaaaaatacaaaaattagccaggcatggtggcaggtgcccgtaatcccatctgttcgggaggctgaggcaggagaatcacttgaacctaggaaggttcaagtgaggttgcagtgagccatgattgtgccattgcactccaggctgggtgacaagagcgagactccgtctcaaaaaaataagaaataaaaaaatatcacattgtatttaaaaggtaacaaaaaaggtaatagaaaaacatgagaccttcagattattaatagtaacacaaacaggcacaaaaagaacaaagtgaaatattgaaaaaaaaaacctagtattatcatgaggcatactgaaacacaatataactaattctgaaaatatctaccatattaataaacgcattatttatcaaattttaataagaaagttatttccacaagaaatcaataggaatggatatctgtgcatcacataacatagactcacattccataatggaaaatctacagaaatttcagggcaaaagagaagaaaacatattagttgcaggagacataattcagtgtgtgaaaactgtcagtaaaaattagtaagcaaatagaagaccactaaaacatgattgatttcaaaatgttacatatcattgtgtttttctccattaaagatatgtcttcataaattctctaaaatttttagttaaacagttttctcttaaattggattaatagtttctgaattaagaacatttaaaaaatatctttaagaaactgctttcaactttatctttcaagtttttggctactcacacttagtcttcactgactcctacatgaactgaaactctaagcataggactaagagcaagtattataaatttgaaggcccatttgcaaattactatggtaggtctctcagttttgcaaagaatcagatgttcagttggctgggaggatatagaaaggaaaaatagagtcccttctctcaaaacccccaagtccagcagggaaaacacaccttatatatcataataaatagaatatgcaagataagctccagtgtatgcagggggaaagggactttggtggaagcagctaaaaggatcttgtaaaaatataaattaacgtcttatgatgcaagaatccagcctgttttaacatggattggatgacttgcttatcagagacttggaacaaaaaatagtggatatggatcacaagttttctgtgatctttggaggaagaatatgacaaaatcctgtatgttgtccttgggataccctcctgacatccccactccctctgtgttgcttgtgcttacagtagagatggctcttctcctaacaggtgctcctcaaattccagatctcattttgctgtcttctctcaggtacctcagacttctgaccgtttttctggttactaatacagactttcattgtttttctcttttgctgcatctataaatattatgatttgtcagaaattttgttttgtatacatttatgagacaatcggccagatggggctacaagaggagacacaggagagactcgagaaaataaagtattttctactcacaggtcctagagacaggaggcatgccatacatggcaacatggggaagaccagagtggtcaggaggcagaaacaggagcaaggtaagttgtaaggcatggcctttgttggggtttctgagagaagggtaaggcaggataggatgaacagtttaggactactttgaataatttctccagaatttgggaaacaggagtgttctctagttgcctggtacctggccctgggttgcttaagacagaagaatattgtttccagggtatgtgggcaaggtagaggaaatgtggctctgggttggttagtttgcgtgcttcaggctggtccctttcctatcttaagtattggcggctgttcgcagtggctcacgcctgtaatcccagcacttcgggaggccgaggcaggcggatcacgaggtcaggagatcaagaccatcctggctaacacggtgaaactccgtctctactaaaaatacaaaaaaattagccgggcatggtggtaggcacctgtagtcccagctaatggggaggctgaagcaggagaatggtgtgtacccgggaggcggagcttgcagtgacccaagatggcgccactgcactccagcctgggcgacagagcgagactccatctcaaaaacaaaacaaaacaaaacaaaaaaagaattggctagcctcaagcaaaggtgatctcttccccagttagaaagattttctaagatatcaaaacatcacaaggtacagaaaatttaaatatacatttatctacaatacagccttgttctgggccttcttttccctcactttctttctatcatgactttcaatccagtagcctaaaatgccatctatcttctaatgacttgcctgagattcactcttgtgtatctaactgcctctttgccccatgaattttcagatatgtccaaaacatacctcttggttctcctccccactcttgcttctccctcagtcttccctttcaagataaatggcaccatcagccaaccaggaggtcaaaccagaaaccattggcttctttaattccattactcttcccttcctatcccacaagcacctacttacacccacatttaagaaccttttaaccatctactcatccacaaaacttagttcttccttcaacagaaatctcaaattcagcaacttccctacacttctgctgccactgccactatcaccctgcaccaagcaagccgctttcatcttaccccttttctgtcacagtatccccccatcatattctccacatttatactcctagctgctctacaaaccatttttgattaatattggtaaaacaaacgacaatcactccccggctcaaaaccattctcattgatttctagctgtattcaggatgaaacatgcaaaccttaccagggtccaaatgccttcctagcataacctgttcacttctctggtttttccaacataatttttttcactcttctttctcccccaactcactacgctccaataccaatggtcttttatcagtttctggaacgtgttcctggtcttgatttaaaggaaatgtaattaaataaagatctccatagaaacactgtctctgtctactctgtctaaattattcccttcctatggtattttccatttcagcagtttgtctgtttccttcaaagcagctgatcacagttgcgattacatttacttgtgaccttattttgtgttttgtcatctggacgttatgttccaggagagtagggataatatgaatggttttctcaccatcagatctccagttcaatcacagagtaataacattataggcaatcaagggtagacacatgcaggacatacccaataaataattgttgaatgaatgatttaagttcaatttgttacaatattttattcaaaatagagcaatcattattaacaaaacatgaaagagaaaaatgagagagagctacagcagggacagcatcgtaaaagttaactgggatttgggcttctattagtggcttcagctcactaagatctttataccaagtcaagtcaggagaggctggagagagagctgagaaggctggctgacaaggctgtctacactccaccttacctgccatggttgtgaccatgctatgcagcgggtctccactgataactttcttccttcagccgtgcttgccttgttactgtgtaatcgggatgtgtttgtatttcttattttggcagaaacactcaagagaaggggcttcattttagtctcaacttacaactgctctctccaataatttttgtgtgtgacatatcctaattaggctcagtgtcttcctgcattcccagcaacttgagtgacagatcattctattaaatttggggagcaatgagactagggcaggggttggccagcaatggcctgaagtccagatccagcctgccagttgtttttgtaagcaacaaattttttggaacacagctgcaccctttcatgtacgtatcattcatgactgccttcctgcaaaaatattagtactgagttgatggatattgatggtggagttcacaaagctgaaaaataacttactatctgcccctttacaggaaaagtttgccaatgtctggactagagtatgaacttctttattctgagccttagatacagtattagaatagtttaactatttttctaacatctctatttatacattattaattaatttcagggaaaattggattttgtttacatcttccaatatcatttagttcagactctattatgttccaggcatttacttaatcgataaagaaagctttttgtgacctttccatctcaagtaatctcccactgctcttaaggcctatattgttttgccaccctagcactttatctctcatagagctctatctcacctggtgctttatctcccgtagcacacagcattttgaccttgtatgtgaatcatacgtgtgcatggctaatctagcctactagtgtggcattgtgtaaagaaaattgtattttgagaatgacagattgctaggctctgagctgcatactagttgggattctgcctcttttgctgacctggaaagttgtccagcgtgtgtcacttggtagacgttttatcatgcatgaatgagtccgcattatgcctctatattaatagagacttgcctccttgatttttgtagatcacagtagaactggatctacaatgaacattatttagcatggcccatccctgccacacacacacatagacacgcacacacacacagacacagacacacacacacatacatacacacacacacccctcactctcactggtgtcttgtgtccactgtttctaatcattaaatagaggataggtttggacactgtacttttacagtcagtcgttagaatcctaactctgtcatttattgagggactttgaacaagatacaaaagatgacctttaatttcctcatcttttaaatgtagctaatcacagccaccttccagtactgtagtaggaagtaaatgagatagcaagcacaactggaaggagctggcatagctcataactcactgtaagtggtcagtagaggtcagttttgttcacaaccaaggcctgcgacttccactccaaaatgctgagggaaaccctgcttctcagttacctgaattgtagtctccaggggtgtgaaagccagggtgcttcttttaatttcctgctccccgtgatttcagatcccctcattcagtctttgccatccttgtacattgcactacaatctgccacagtgtggaagccagaactctgagtcattactgctgttccctgcatccttaaggcctcggaaatatatctttactcagtccacttctcacttagtttctcagtcatctgtttaacccaaactatgattttattttccctggtctgattgaaaaatcttcatcctggcctccctctatctccttctccatatgaaaactagaactttttttttttttttttttttttgagacagagtctcgctctgttgcccaggctggagtgcagtggtgcgatctccgcctactgcaagctccgcctcccgggttcatgccattctcttgcctcagcctcctgagtagctgggactacagacgcccaccacaacgcccagctagctttttgtatttttagtagagacggggtttcaccgtgttagccaggatggtctcgatctcctgaccttgtggtccgcccaccttggcctcccaaagtactgggattacaggtgtgagccagcgcacccggcctaaaaaaactagaactcttaaacacatatatcagacaatgtcttttcaaaaactcctaatgatttctaatgaagattaacataatatcagatccctatgcagtggtctacaggctgtcatggagatgcctctaaattaattgcatatcttggagtttgttcacagtataccaggctccaggtcccatgaactgatgtcagtagcttttaagaccaaattattttctgcctcagcacttttgaacattttatgcctcctccttgtaaatctttctgcctctgtttgcaaaggtcattctttatatccatcaggtgtcagttaaaattatactgttggagatctctatgaatactccattctttttgtcattccttttcttagaatcctgtttttcctgcttattcttacaacaatttgtaattttataggtagatagctagcaatcatttacttatttttgtttgacattcctattactttgtgtactctgtgaaggctgaactatgtctacttcattcattcattcattcattcatatatgctcagacccagtgcattttttttttgctatatagtagtgcttaatatattattcttgaatgaatcaatcatttgatcaatcaacaatgattttaggcaaatttacctctccccagcatattttcctctgagcataaatggctcactgaaattctggcctgtaaatagaaatgtatatttcctaagaagactgcgagtataccaatgatttgaaaaatgaacagaggttcttacatgactttaagaagataattccctttcaaaatgatgctttttccaaatctagtaacaggacaaagtaagatcattttgttgcttcactctttaacattttaattgtcaaagagcttggagaattctctttgaggtttagtgcacagcaaagtgtaataagaaaaagtattggtttcaggttacaattggtaaaagaaatattttaagatgtctttcagcaatcttagtgtttctctgtaatcataaatttgaaggtactgattttactatattggtagtaatcttaaagttaatactctagctgcatatctcagaatgatatacaaaacaaggatttccattttatttggaattataaaatgcttttacaaagcctgaatttgtccatagctcatgaatattccttttgtagtgttgttttgctattttagaattcagcaaaagaaacttgaattcagactacattctaagcatcaataagtatagcaatcctataacacaggcaaatataaatgcctgttctaaaaaagcttaaaaagaaaaaaaaaagtccttactgagtatataaaatattacgtttttactcatttaatcatcatccatgaggtgacaactattatctcaattttgccagtggggaaagagtcatacagaaaagtcccttgttcaaagtcacattggtagtaagtgactgtaaggatttgattgcaagtttcttaaacatcaaagttcaggttcttttcattgctgattgccttctgactttttgcatcatccagttctttttctttctctccccctacccttttccccattctccattccctttcccctaccaccttgagacaaccattctaatttacataatgtgtacatctggatttgtgtgtgttcttacatgcattttttatttacttgatgctagtttccacttttttgattaaacattctatttttcagctcacgttgttgtgtgagcatataatctatcacttctcattgctgcatgattctgtccattaatggaaaacctgttttcttctaaccttctaccatcataaattactctgcagctaaaaggcctatgtcacttatttttagtgcattatttttaggttataccgtatatatatatatataatatttatataatatatacttcttgtgcctaaagttctttacttcctccaagtcataaagatattttctcatggttttttcttatatctataggtttacatcttagatttagatttttattccacctttgtatctgctgttagcttagttccagttttattttgatatatagtatgagccagtatttataatacgatctattaaacaattaaatagtttaaatatttttgtattgtattcacaaaaaggaacttatttttaacttctatgtgtgtatatatatgcatatatacatgtatacacatatatacacatacatatatattttttgagatgggagtcttgccctgttacccaggcgggaccataggcatgtgtcaccatgcctggaaaatttttgtatttttagtagagatggggttccgccatgttggccaggctggtctcgaattcctgacctcagatgatccggccgccttggtctcccaaagtgctgggattacaggcatgagccaccgcacctggccaggttgcaccatagtatctaaagatttttctgtgtctttacaaccattttttttgccaatttaattggtgtaaatgatatttattgttgttttaatttatctgattactaattaagcatctctttgtttacctattagcattattagtttggcagtcttaaatatcacaaatatccttcttcattctgtaatctatgactttttttgcttattttttgctgcctttgctttaaaagttcttcacttcctccaagtcataaagatattttctcatggttttttcttatatctataggtttacatcttaagatttagatttttattccacctttgtatctgctgttagcttagttccagttttattttgataatatagtgtgagccagtatttataatatgatctattaaacaatgaaatagtttaaatatttttgtattgtattcacaaaaagaaacttatttttaacttctagagaaagaaaagtgactcttaatattataacgcctttcccataatagagtgtactggtattttttttaaaataagtgcaagtcatattttatgcctgttttgaatctgatcaaaaaaagtttttcctatttgtgtgagtctgtaaaggcacatttccttttgttttttctgctttagcctagagttctcgttggaactgacatgacataggattttacattgaatagttaaagaaaaaataactctttttccccccagcaattaatataccactatcgatataatgtgattttatcagtttaaatggaaaactgaaattaaagagaaattctctattaaagataatttattaaaattggtaaattatatgcatttgaataaaaaaaatcattaacagacttttatttcttttccaaatatgaagatgaaagtgtagatttcagatacatataaaatgcatgttttattatagcattatatgattttaatagaattattttccactaaatgatggttgcttaagaattttggaagaatggaatttttgaagtatgagctagaactgaagggaagatgaagagtccgaaatggttcctaattccattaggggaaaaagacttttcaatcagtcactcgagtgtccacagagaaacgtctgatgctatttcaggggataatctagtggaggaagatggcctcaattgaaatgcttagttgattatgtagttcattccagaataaataggctatttactttgtctgaaagttcaatagatttggatttcagtcaaatggaatggcattagatctttctttatgaatgttgatacaagtgtgtttagagaggacttctgtcagtttttattagtaatattcttattggttgagttttcttctccctcatttgctcagtgctccaattttgtggaggtcattttatttttgacgttatgacataggcaagtagaagcctctaagattttttttaaaaaaccctgttacaatgttttattcttataattttgtaactttcttaatcaaatgctgtggagacaaactgcaagaggaaaggttctttttaagggtacacacatgttggagatgaaattccttgagtttttgggagaaaataagaaacctgctgattctctgagctagaataatttatacttttctatgaacattagagaagtgatatactttaaggtgtgaggacaaaaacttgcaaaaaaacaacattgcatttgaattatagatggcatctaaatgataaaatgtataaaaatatccctaaaagataatttctttgtcataattgagaggggagcagtagcgtataggagagtttgccacacagaagatcaaatttcagctctgacatttcctactttgagaatctagctgaattacaattctaaacttttgtccttatcagtaaaatgtctatatctgacagtatacaaggggtatcttttgtgcctagcttaactgggccctcagctgtttatttttttaatttttccttctgtcctccatcaccattcccagattcttacattaaggacaactaagctaaacattactcataaggaagacaccttgtttgttttattaatagctagtttagcacataatacattttaaattgtctgcctatgactaatggcaaaaggtgtaagtccgtatttctttagagaagtaaaataattggcctttatttacagtgatcttgtaatctttgttcttttgtggtggttactaattatgtcagtgtcaaactaatcatattaagtaatggaggttaaattcccccagtgatttagaatacaagaatggaatattttggcattaaagaatgacttttcttttggaagtacatcgcgaagtctttgcaatatacatatttgtcaattaccatctgtgtaaagcaacagacagctgctcagtagcatttcctggagtggactggaaggatctttctcaccatatgactctgagacagttagagacccaccaaattgaagattacttgatgtaaattcacagcacatacctggttgatacagtttatattaacatgtttcttctaagaaacaataagctcttttttttcaataaggaaaatatttttatctgggaaaaactgtacaacatttatatagtgaatgatattcttttaaaataatttgttataagcctttcctaacagtgggatatgacaaactagaacatgtgcaatacaagtgatattttaagaagacactcagaaatgtaatccaacttcaatcgtggatgccccccagttttgtttgttttctatgtctggaattttcttgtcataaaattctaaattatttaaggtgaatatcctttgcaaaagatggtgtctaaattatgtctccagaaaagttagaaacctgcagtttcaggaatattttcattgagtacccatcaagtgccagaaaatatattagggacaaagaacatttctgtaaatagaacaggcaatgatatttgcccatctgttgggcttgtattttctctttgagtaaccactatgtgctaagtgaaatgtagtcaatttaaaatggtttataaaataataagaaaaaagtcatttataggtacaacattctttctaaggagtgcagaagctgaagttattgttttgctgagacctggagaggtttgcatattcaaaattgggggaagagctaattacttgtattgtagaagaagactttggaattcttgtggaggagattaggtggagagagagggtgggggtgtgagagagagtaagaaagaaaaagtgaagtacatgtgtttcccaaatgttgtgtttctgtacatctcaggcagggaacccattctccacccatctgaccacttctgccttatttacaaattttgatttgctggaaagggaattctactggcaaatgcacagtctgtttctcactgatacaccttggctgagtttctacctacagtctgacccttttgaacagaaagtgttaaggacttcccgttagggctcgtgcttaagcctcaggttgaacctacttgatccttaagaaaagcaaacaaagcaaaactctcaaacagaaagcactgtgtacttatttccttccataaaattttattgtgcactgtgttgcagggactttgctgagcttcacaaatttccttcatacaacttttactgcatgtaaaagagacccactccaaagttaaagtgatatgttgtcagaacatgaaatcaaaccagaagtaaaaatactggatatgtaaaaaatataacagccttctagtaaatatgcaaaaatcaaaatatgcaaaaaatcagtcttctagtaaatgcaaacatattggaaacatgatcattactgataactagaaatatttctaatagcagaaaataaacagaaaatggagaagacataatcaaagaaataataaaagaaaatatgacttaaatttacaatacaagtgccccaccacaatttaaaattttaaaaagacaagctgaaggcacatatttatgaaaattcataatactagagttaaagaaaaaaatttaaggtctttagaaataaaaattaagtcaaatcccggtgattagtactcaaaatgactttacactttccaacagtgatcctagaaattagaagaaattgcagcaatgtattcatattctgaaggaaaataactatctttcggtctgaattgtcatgattatataaaggttaagtaaataagttactccaactttcccaagttaattttttaaagaaacatagatcttgacttccagctaatacacaaagtttttaacctggaggaaactgctaactgagctgtgatggtaagtaaaatgtgtatttcttttcttttgggtacaatagctatatcattatacagcaaaggagagaaattgctacgcaggatttagtgatattttcaaggatagcatttaataggagaaatttctgcttgaggtgaagatctgtctggaaatttttgttagactaatttttttaaatgttaattatgatgctatactttttctgaatcagttcaaggagattaatagtcaaaaaagaaggtgtgcagacagttgcttaatgagatctgagaaggaaatttagaatcctatgttcttttcatcatcaacaggcattttacctaaaagtctagaaagacaccattgtgattttttttcctttgtcctgtaactctttcctatggcttggacagtgacaatagcattcgtgctgttcaactggcagggaacctaattatggctgttttatctgaagctcagataatttcagagctctttgaaaagattattaccttaatctaccagttaaattcttcagtgcacttatgagaaccatagcatcaactctgtagattgtaagagaaatctagaatttagaaagatgagggagtgagcaaaatgagcattgaattagatgtctggagacctaggttctggaactatttttgggtagttgacctcatctttttggagtgccattgcctaatcagaaaaataaggacgatggaataggtggtcttctgaatctaaattattttgttgaatttttttctctactttgaattctcaaaaatattttgctttagaagcgttctattagtatgtataatgatgtaaagcagcggtccacaaccattttggcaccagggatcatttttgtgggtaacaattttttcacaggccagggggtactgagagcgggggatggtttcgggataactcaagtgcattacaattattgattgactgattgattggagacagagtcttgctctgtcacccaggctggtgtgcagtggcttgatctcggctcactgcaactgccgcctcctgggttcaagcaattctcctgcttcagccacctgagtagctgggactacagatgcccaccaccatgcccggctaattttttgtatttttgtagagacggggtttcaccttgttgcccaggctggtctcaaactcctgagctcaatctgccctcctcagcctcccaaagtgccaggattacaggtgtgagccaccgcacccagccagtgcattacatttattgtgcactttatttatattatcattacattgtaacatacaatgaaataattatacaactcaacataatgtagaatcagtgggagccctgagcttgtgttcctgcaactagagggttccatctgtgggggatgggaggcagtgacagattatgaggcattagattcccatagggagagcataacctagatccctcgcatgtgtagttcacaatagggttctcactcctgtgagaatctcatgctgtggctcatctgacaggagacggagctcaggtggtaatgcaagcaatgggcagtggctgtaaatacagatgaagctttgctcactcaccagcagctcacctcctgctgtgcagcctgattcctaacaggccaaagaccaatacaggtccatggcccaagggttagggacccctgatgtaaaagacttatatatgttggtgaaaagagcagacacagaggaaattccacacacacatggatttaaatcttggatttattcttaggggcagtatcatctggaatggattattctgcctctctgagattcaccttctacaactataaaaagagaaacatggcacttagttttcaatatttttcaaaaattgctaatagtataagtacctgacataataaaaacattcaattaatagcaactgttatttgtgtgatgttttctaacttaagaactaggacatgaatttaaccacacaggaattctcatttttgagaagataaagaatgaggaaaatctgaaaaatattggaaatcattaataaaattctcctttgatcaaagatttatttcggcattccctaatttgccctgctcttgggtacgttagaatacatttatcctactttacactttgaaaaatttgtgcaaatgccatgattgtagcattagcctgattttttcccagtcttctggtttttttttttttttttttttttaactcaacatatattgtgaaacactcgggtatttattcctcaggaaagtatgacatatgaatgagagctagaggataagatcttgtgataataaatttttgaggttagtctctctgtgtccttgcagttttcgcatgtaactacttactctgtggagtctacacttatatgtaaaaggcagtttctgtgttagctggtttattttaaaaagaaaagacttggggcagtgaccatctcccttatctgaagacagtgatattagatcattcccagactggcctattttgctttcacatactgcaaaatgcttgatatgcctcatttttgtgctttagtaatcattcagactttgacatgcatttcttgagggtgttataacatgtttttgaattttctccaggaagcactctgatgatgtgatgaataatttagctggataactatttactagagaaaacacgaaggatgaaaaaatctaaacaaacttttttcactgagataaataatgagggcacctactcttttggcaaacggtataattactgctttcctggttaccagtgaaatctgggatatgctaatgctttggcataaacaactgaatataaatctcaataattgaagtttgaccaaaagaggggttaaatatgtctaagaggtcaaacacagagcagaaaaaaaagaatgggaaatgatcttagtctgaatcgcaagattgcatgttttgcttttactcaaaagagaaggaactggtatttagaaggagtttttttttcagagagtaaggcgttcagagtcactgggtctgagtgtgaatgctggcccacctgctatgtgaatggccttgagcaaggaaatacatctctcagcctggttttccacttctctaatataggatcacaccctctgccttggctacataagagaactgttataaggtatgctaaagttgcaactgagaaaacctgccgtaagctataaaggactaggaaatgtcagaaatgattgtaatgctgttggcccttcagctgcagtgccagctgcagaaattaaaaggaggctgaaaatttgatgttgcccttggaagtgaggggaaacattgttctcctcagcaaacctggtctaacatgtctgccaatccagtgaacgtatttcagcatgtgtcatgtgggatgcaccttatgaagggctgtctatacagatgttagggtatatcttagttaatttggcttataacaaagtgccatagagtgggtagctcataacaaataaatttatttttcacagttctggaagctgggaaatttgagaccaaggacccagcatgttcaggttcctgtgtgggctctcttctgggctgcagacggccaccttctcgcatgtcccctcttagaaagagaataagagagctcttgggggttccttttataaaggctctaattctgtttatatgaactattactgatgacgtaattacctcccagaagccccaccttcttatgccatccttttgggggttggaatttcaacatatgggtttggagagacacaaaccttcagtccattacagggtccaagttgcttcatgatccacaaactaccaaaatctaatacttgatacaaattcacccagaaaaacattagaatacagggatctgtcttgttctaaaatgggaatttattatgcttaaaccaaaccttatagtgaatccttgaaaattcagaccagagtctgaatgtacccctctagggtacttaccacttggatatttctagtaatttataatgagcattgagactgcccattcagatatattcatatacttctttaaataatcaaaacgtgttttctcttcccttctatttactgctgattttcattctacctaacttctctgcaaagatggtttaccttggtaactagcaataacaataataataatagtaatagtagtaatagcaaaggtatcatttacttaactccatcagaattttacatactcttatttctgattttattatttctttaccatgcaaatttgaacagaatcatctctgtccaatggcccatctttcttattactcatccactcttaactgcttgcaatgtataaccgtaaccctgctctaaaactactgacctaacaggcagcagggaattccttttattcagttcactagctctttcaaaattctaatctgctttgacttttcagtaccatttaactctctggaataatttctttgtttttgaaatcctctatactgtggcatgtcaatttatacctttgtgagagcttcttggtctcctctgtctactccctctgttcccagtccctgtgtgtaaattctgccctctccattcccactgtgactcctcagttttaggctgtcatcatttctcaccaagatgttgaactggctcctccgtgagagagcagagtggagaggtgaagcaagtgtctgcctgccttcctggtccatgacctctccctgcccttccatgctgggtgaccatctgcatgtaaagttggttttagctttcttattggtgaagtggggataataatagtatctattttttggatgaatgggaggggtcaatatgttactacgtgcaaaaatgcttaaaataattcctggcccttggtaagtgcaacataagtgctgccattactgtctttgttttaatattagttatgatcattatcattttaagtggtctccctgctgttggatcacttgcttccagtacattctgtacacagcagtcaaattattgtaaaacaaagcttagtttatgttactaagctgtttcatattcatatttgcattctatattgcctaacaattttaatcaggccctcaatagtcctggtttgtgtttcctggcttgtctgcaagtctcagtataatagtcagtactgatgtctcccttccccaccgtgctttccttactttctagaattgtgctttccttccacctccattaaaatcctacctgccattcacaagacccagaacaaatgctaccagacccttgatgccttttgtaatcctctatgatcaagcataagtctgtcctctctgaaactattaagtaaaggtctttattttaggtttctttttggccccatatctctgtatttggtattttatttatttatgtacatgttgttatcttttttcctagattataaactccttggggaagagcctttatatggccttccagctccctgcacaggacattacatccagtagacagatgttcaatgaagggctattgaattcatgtggatttccatgtgagaatagagctggatattcacttccctttttgctgtgcttgctaagcagactcatttgcaccggccactaccccagttggtcaccaggaatagagggtacttatggagattcttttcccaccccccaccatcttttaggatttagatgttgtttatacactgaaaagttcagcttttggctcatagtagcagatactgttggatatttgttgaatgaaaaagaaaataaatagtaaacatttgctgagtgagaaagaaaaaataaataatgaataaccacaccctgacccacttgtctgccagaagtgggaaaaagttgtaaataagcattttctggaggaaaaacacacaacccacacttgcttctgaatggtgtgggaaacatagattgagtctaaaattgagaggcatgcttatgtttactaagcacatggagaagcattatcagaacactactggcttttgcaatacattctttcgtcttttcaaaagtaactttttctatcacatttggcttaggttaagattcaaatcaatttacccttcacttgattcgtttttgtcagtgtggtaaccttatcagcaatgcagtttgcacccaaaaagatttgctgcagaaatgaatgaggccctctaagcccaatgtgaatataaactccacagcgatggtagaaatggtctcaggtgacccgtcagaataagaagtacttcctctccagaggtcctggcttgttatcccccagagccacacagtgaatgaagctaaactcctgttcttgaggtggaattatctcataacatttgacactttagtagtttataaagataacccaggaaataaaatttcaggagttgaaacaagtattcactgaagacaggacaactaaaatatgccacaaaaattgaggatcaatatatcaatatggaaggtttttaaaaatttttatttgtttaacttttatttttgtgcttggcttttcttgggatgtatttaggtatgaagacagtagaaataagatgtatacactttgggaggctgaggcaggtggatcgcctgaggtcaggagttggagaccagcctggccaacatagtgaaaccccatctctactaaaaatacaaaaaattatctgggcatggtggcaggcacctgtaattccagctacttgggaggctgaggcaggagaatcacttgaacacctgggaggcggagattgcaattagccaagatggagccattgcactccagcttgggcaacaagagcgaaactccgtctcaaaaaacagaatgacttctgctgagatatcaagaccacgttggtcttgacccctgcttccaggaagccttgcttgactgtctagggctgaattttataccattttaaaagaccctgctaattcctgtccttacatacatcacatagcagtgatcatttaattgtccagactccccatctacgtcacaagccacctgaaggcagatcacaactacatagctccttgcctggtgcctggctctagtctatatttaccggatgctgtattaaaagaggtaaaaccaaggcatgagtctgctgttgcagctcagaggcctcaatcagacagatgccaagctgcatttgatcggcagtcttgtatatttgactgacaacgttctggcttgcaagtatttaataacaacagaaagtgaattagtcaccaatacataaaaattgagagactttacacaaatctgaattcctgggctctcttgaaatacctgaaaatctgacgacgttggacgtacattgctacaaaaacctggagaagaatgtcatggctatgaatagtgaaagtattctccactctatcctattccccctggcacttaaagcttccttagttctcacctctaacaacccactgggcctataggaacttggagctgttccttctcttcctgggtgtctcattagagggatgaccccaagcttctcctccccctcttccctctgactcttcctcttgttaaaagagcatggatcttgcttcctaagaaggatcttatcctctaaagccattgtcctgctgagcgacaggaagctcctcatctacagtggccctgcaggtaccgagaaggcttttcatgcagctctgactccacatgggagtgatcacaatcaggattccctcacagactgcctggcttcagtgctgcactctcctgccttgagtcttgaactgcttcgtgatcctgaccacagtcttgtcacctgcttggcctgagaagcatgaaggtggtagatcctggtgccgctcctgaccacccagcagataacactttgattttttttctaagtagaaattgatcagtgtgggatttcgagattttcaaaggtgcctttgtttaaatcgagaattgggcaaggtagggatcttcgttaaaaagcaccatgtggtcaccggggttaatgaggcagatcagagcagcactgacactaaataaaggccaattaactccaatcactgcaggcctgggtgctttctggcagtgcaatctccctgtggggggcttcttgtcctgacaactctctggcagaggtaaggaggactggctccaaaagaaggcccctgagcaatggtgtggggtgagggcattgcccctccccaccacactgcccatcaggggcttatggcttttcttggaaggcatcgcccccacccagcctgccctgcatggtgctgtggacagagaagcaagactcagagactgaggccttctgtgggctcccaaccagctcaggggccaagcacagagattcagattctcaagaccccttttctctatccatttaattaattgccttgaagagaggatcacagagttcttgctgaaaaattatttaagtccatgaatgaagacaaatgatttcaacacaaacattgctcaattgggtacaaaaaatttttttcccttgtgtttgctttagtgataaaaatagccagtgctgatgatataaatttcacctcgtgccaagtgctgatctgaaacctttacctacattggctcagctggtcttcacaaattttctatgatatggatactattattaatcccatttatacatgggaaaacagaggcattggaaaagttcagttctatgctaggtactttccatgcctacttctatgtgattctcataaaaacctctgtgtggtgagtatttttagcactatattacaaatgaggacactgagattcagaaaacttgtgtgacatatctggtacagtattgctcctaatgatactaataaaatgaggatttggattcactttttttttctatttccaaagtatggtggtatagaatagctaactgcctaggctgaaggatttaaaatttttccttaagatttatctgtgagccctcagtttttctattcaaggtttctggattggagagtataatcagtaccaaaaactaataatgatcttaaaatagtgggtacagaataatgcctctggctccagcttgctccattgagtttcacacctggctgtattactttcttgcttctgacttctttcagccactaagccgtggatgttctcagtcctcagtcattaaagactagaacatcgcccaaagccaccttcgctactgcaactacagtcattagcataacagacctcagcatccacagaatcacttcatccaacaccccgatctctcattccctttgcctcctcatctccaaccaccttcttcgcttcgtctaagccacacatttcatcatcataccttggaatttcccaataccaacaactatatcagctctaatattccatgttaaaatgctccatttgtttatcaaacaccctctgttactatctggttagttcaaatacctcccatattctctgacctcacgaaactcccaatttcccccaacacttagctccctgggagcaccacttttctttcactcctgcttggatgccatgattccagcattagttgctctcttcctacttcaaacccacaagatgaaccttcctatcaaccttctccacattgacaaccaagaagttgtagacaatcacacaatgggggagcttggctgtattgtttatgacatacattcaggtcatctctaactgagctgtcagtcctgctcaacagtctcactaatttttctttcgagctcactctcccaccttttatgctaccttataaatagctcttctccaatccttccgtttcttttcattctcacttcaaacacaccagactcagccaccatcaccttactcaaaagcacaaatatttttctaatcagtcttcaattcagtcttgccactttgcctattcattcaccacacataagtcaaaataatgtgtttagatcctacattttatcatttgattcccctgctttaaaactttagtgtcattccatagctaataagataaaataaaaattcttacctcggttatcctacaagtattggttcatctggctgtgcctaaacctcaccattcttgcatacaataatccacccctttacattctaccttcatgatcttattttagtttcttgaacatgccaagcttctttccaattcaatgtattttgcatttgttacttatatacttgtctgtctctgaaaaacagctcccgttcattacccagctttcactatttcaagatctcaacttaaatatcacattcacagtttttcacgaagccccctctacccctgtctgttgtgagtcactgctcctgtcattcactcttccagtgctgggtgcttttcctttaaaggaccaaccatttttagaatatttacatatgtacttatatttttaaattctatcttggaaatcagattgtaagattaagaatggaaggttccagatatgctcacttactattataagccaggatctagtacagtgaaacttgagaaacatcttataaacatttaattcactttaacgtaaactagatttgataccttggacttggtgttaacctcccagaacctaatttcctgagtggcacaacaggggcacaatactcctgagaactatgatcaggttgcagtgtaataatgggtggaatccacactttggcaattctacagtgctttgccaactacaaagctgatgacctcagtgacagtgagcacacccagtgcccagagcttggtttgtaataccattcatcaattaaaacaacttggtttccttggagagatggatgattctagggttaaagcaagaaatatatatttacctatatgaacctggagcatcttatactgccagaaagcaaggaagtgctaaaaacaaaacaaatacacacacacacacacacacaaaacaaaaacaaaaaactcacactgattgttagatatcaaagggacacaggagccaacaaaagtatttcaaatggccaaagctgaaaaaatttgagcaacaaaataaataaagtagttttgtattataactgaaagtataagacaaatgttgatgagaccatgcagatataaataaataattgaataaatacaaaaatgagaaaaagagaccaatatgccatgcagaagaatttacgataatttatgtagatattcagtccttgaggtgttggctgtacatagtgaccttgtttctccttcctgaagagtacacagggaaagaaggaacaaggaataactaaatggtaggaaaatctgacaaacactaccccagcccggtaatcaaggtcaatactcacaatcataagtgatgctgatattatgtacctttgataggacatgatgaaaatggcactttacatctgtagtcttccttcctggaacccataaacccaatctaattgtgagaaaaacaccagacaaattcgaatcatgggccatcctataaaatacctgaaccagaactctttaaaaccatcaaggtcatcacagacaagcaaaatctgagaaattgacacagccaaggggaggctaaggaaacatgacaatggaataaaatgtggtctgctggaggggatcctggaacagaaaaggacatggggtaaaaatgaaggaagtctgaatagactgtggactttagttgataacttcctatcaatattctttcattcacagtgggaaatacaccatattaacgtaggaggtaatgcaattttatcttactttatggtggaaataatagaggaaactgggtgtggagtatgaggaaaacttctgtactgttttctcaatttttctgtaaatcttttttttttaaaaaacaaaaaacaaacaaacaaacaaaaaacacagagtcttgctctgtcgtccaggctggagtgcagtgtcatgatctcagctcactgcaacctctgcctcctgggttcaagcaattctcctgcctcagcctcccaagtagctgggattacaggcatgcatcaaccacacctggctaatttttgtatttttagtagagatggggttttaccatgtcatccagggtggtctcaaactcctgacctcaggtgatctgcctgcctcagcctcccaaactgctgggatcacatgcgtgagccaccacacctggtcaatttttcaataaatctgaaacttttcctttttttcttgagatggagtctcgctctgtcacccaggctggagttcagtggtgcaatctcgtctcactgcaacctccatctcctgggttcaagtgattcttctgcctcagcctcccaagtagctgggactataggcacacgccactgtgcctggctaatttttgtatttctagtagagatggggtttcaccatattggccaggctggtctcgaactcctgacctcgtgatccacctgcctcggcctcctaaagtgctgggattacaggcgtgagccactgtgcctggcttaaatctgaaacttttctaaacatgaaatctactttaaaaatactgtgcatcatcatcatcatccacttgctgtggtctaaaaatactcagatgtatctaccttctttcccccaaatcgatgcctttgttgttgctttcaatgtacgttattttgaatgctttgtatactgtagagtgctccacaaagtcaggaagctctttttcttgtatggctcactgccctcttcaggtgtcacgctggatgttctcaagttatctctggtcttgtcaggctttactcctccttcctgtcctgaggcacaggcttgcactccctctttctctacctctgtgtttgctcacactcttgctctctatcctgctgctctaccttctctttctgttcttgtgggataactatgggaataaaattcagatttattttcctaattctcttctgaaaattttgaactggggaatattgatgtcttctatttctatcttctaactttacaaaataaggatattctccagattcacaaggaatgtgtatgagcactaagagaatgcatttggaaccctttaggcaatggaagaggaaggaccagaaattcagcaaaatcaatagctgagttcttacagagaaagagaggcagggaacattatgtctctatctatgatgagaggcatgtttttctactctctaggaaatgacttcctgcaaatgatggccagataaatcagaggtcatggtccgtggaattgctatttttctcagttgacaatgtgtagacgacagggtttataaccagtactacttctcatgccatttgctctgattttataacagcgacttcagctccaattgtggacctgattgcaagatagtcttaaattctcaaaaggagctagaaccctggaatgtatgtaaattttttaaatttatttttaaaacctgaatgccaaaaagtatttgaatgaaagagtcaatcagtccaaaaacaattgcgtacctctctggaaggtctagtgaaagggaaagagaagagagaaggaagaaaggagaatggggaaaaaaaacttttcttccttttacatatccagctgtaatgagttcagaatgcaatattgtgccagtgggttacagtgtgtttcataaaaggccttcaattcatgttagttgagtgaataaataaagagatacattgaaaacaattttaaggtcttttgtaggagtgattagcaaacatttataaatacaaaaaaaaaagttattaagaattctaggccgagcgtggtggctcatgcctgtaatcccagcactttgggaggctgaggcaggtgaatcacctgaggtcaggagttccagaccagcctggccaacatggtgaaaccccatctgtagagatatacgaaaattagccatgtggtggtgggcgcctgtaatcccagctactcaggagcatgaggtggtaggattgcttgaacctgggagacgaaggttgcagtgagccaagatcacaccattgccctttagcctatgtgacagagcaagattttgtctcaaaaaaagaaaaaaaaattctgatttttcctatgatgtctatctaacaaaataaaatcaccatattttcttgcactttgccctgaaaagcatagtattaatatggaatgaattggagttaggtaaatctaagtttaaattctacccctattacctgctaactacagggccttacatgagtggataactctctcctccttggtgtctgcatcttgcataagtctctggctaaactcatcaattaccagatactccccatttatttcccagatagtgcctaacacacatcctttaacagagagcaaggttttgtagtcatctctctttgtaaccgctttgttatttaatagttgtccagatgcagcagtgctgtaggtgctgtacgagaataaaatgcatcagttaaaaattattccaacctagtttattgacattctcaattatattggtcatgaatggaacgttcctagggaatagatggtgataatagttgtgctcaattatggccttatcatttttaggtgtcctctgttttctatgactcataattaggactcaacatttttatatttgatcattttatttttcttattagagtccattattctcctgtgaagttttgccagagatatggcatacaaattggatttgtgtatgctgtatactaagtagacatttgaggaatgaaaaatatgaattcacaaattaggcaggcatccttgttgtatctatcatatggattttcatgacacagactaaataacaatcattgcacaaaggccgtagtgcagcagggcaaatggtggagttacttgtttgatattaattcagtgctttgcccaataatgcaaaattgtcctaatgttacatttgaggaaaaagacacatcgagtgccagcattcaaacaggcagtgtgttaaggatatgtttataggttgccttatcaaacagttacaacaaaccaagagaggagttgtctgtccttcaaagtttagatgaggaatgtgaaggttggaggtgtgaaatgccagtcttatggccacatagctcccttgtgatagatccaggatttaatgctgggtatatttcacatcaaccataacataggtcttccactttgagaaagatacgtatttaattttacttggaactcgggaaattagaaacaaaagcagctgtggattgaaagataggaattgtgcagattgggcctgaaactgatatccccaggaaactaattgtgaaatggaagatgaaagttgggtgctgggtgtgacagtctctgggattattccagagctcagacctattctgtggccttatggaattaatgcaaccccatatgaaagggagcttttcagtcaccatgggttaatttcagacaaataaaacatctgccattgatcgaaaatctgaatgttcaattttacagaagttgttatctttttcacttcagttcactttccatttaaaactgaaaatcaatccttctcagggcctttgtgtgtttttggagatgcacactacaatttcctgccaaaatacttgtcaaatgttagcatacatttgacaagtagtccttgggccagagtcattaagataaaaaatcctggtttactcaatctaggaagacccagcgcacctgacaccaagtctgtgcagagtaaccttgaattcaggatgtttatgaaaattccagcacctacactcctctttattaattataaattagatggcacaccgtagtaatcatcttgttaaacacagccataggcaaacttagaaaaagaaatattaagtaaaaagtagtataataaaatggcagcagaacaactaggatggagtttgcaaacactgaccactccgtaacaatgaattaggctgggtgtggtggctcatgcctgtaatcccagagctttgaaaggcagaggtggaaggattgcatcagccccggagtttgagaccagcctgagctacatagtgagaccttatgtctacaagaattgtttaaaaatattatccaggcatggtgctgcacacctatagtcccaactactcaggaggctgagcggggaggatcacttgaggacaggagtttgaagttaccatgagatataattacacctttgcactccaacctgggtgacagggcaagaccttgtctctattaaaaaaacaaaacaaaactgataaacaaataaataaatagataaaaataaataaatgttattcaggctgcagccaagtatttcctgttgctacaatgccatactttctattccctgtcccacaaaatacgcattcatttctaaggctgaaaagttgcctagacagggttggttcataaatggattgctctttcagtcataacaaaaagcgatacatcttcatagtcaggctaaagggcttagtaattcaccttatctgtgtatctcctaaagaaattagcaaaatcactgagtttggcgtttgtacttggtgccctggctttggtggaacctataatagtggtacaaataacacatgggagacgtttataatgccaaagcagctagagttgtaagtgcagcattataggagtagagtcatgtctttcttggagcatcaggaagggattcttagaagtgacatgtgccctggattaagtagaggcctgaggcatcatattccttcaactttccaggaaatctcaattatatctggaattagatgctgggaaataacatgacaatgacaggttgggtaaagacaatgaatgggtcaccaagaggtttgccatttatcttttaagccatggcatttgcagtgggaatatgtcaggatcagatttctggtttgagatcgctagagaagcagagtgagaatggactggagtggtagtgactggtgacagagagaccattttagtcttctccatttcactgagtaaaattagggagatagtaaatctattaaaaaggtagtctaagctgagctggggaaacatgacccccccatacaggcaggacacaataaatgactaataaaacagtatacatttaggtgctacatgatgttgtacagccttcatgtggtaaaggagttctgtgaagcaagtgagcagagaggtctggagttgataggcttggaaatttgtttcctcaaaatctcatgttgaaatgtaatcaccaatgctgtgagtggggcctggtgggaggtatttggatcatggggcaggttgctcatgaatggcttaataccatccccttggtgatgagtgagttctctctcttgcagttcacatgagatctagttgtttaaaagagctagagactgatatggtttggctgtgtccccacccaaaatctcaccttgaaatgcaaaccccataatcctcataatccccacatgtcaagggagaaaccagctggaggtaattgaatcatgggggtggtttcctccatgctgttctcctgaattagttctcatgagatctgatggttttataaggggcgccacccgcttcactcattcactctcctgtctcctgccaccatatgaagaaggtcagtgcctgcttccccttctgccatgattgtaagtttcctgaggcctccccagccatgtggaactgagagtcaattaaacctctttcctttataaattacccagtgttgggtatttctttatagcagtgtgaaaatggactaattgccgagaccagctgggtcgtggagaccttaacccagcggcgctagaggaattaaagacacacacacagaaatatagagtgtggagtgggatcaggggactgacagccttcagagctgagagccccaaagagagatttacccacatatttattgacagcaagccagtgataagcattgattctatagattatagattaactaaaagtattccttatgggaaacagggatgggctgaaacaaagggatgggctctggctagttatctgcagcgggaacatgtccttaaggcacagatcactcatgctatttttttgtggtttaggaacgcctttaagcagttttccgccctgggtgggccaggtgttccttgccctcattccagtaaatccacaaccttcagcgtgggcatcatggccatcacgaacatgtcacggtgctgctgagattttgtttatgaccagttttggggccagattgggggcctgtgcctgacactaaacagagacctcccccttctttctcttactcctgctctcaccatgtgatgcacctgctccccctttgccttccaccataattggaagcttcctgaggccttcaccaggagcaaatgctggagccatgattggaaagcctgcagaaccatgagcgaactaaacctcttttatttattacttacccagccttaggtatttcttcatagctatgcaagaatggactaatacagtagtcatcaaagtaaaggtgagatttgagttgactattgaaaggggaggaaggaataacataaattgtgtcacagacaaggattggttggtaggacacggagtagtgacaatcctgacatgcccatgttttatgcttcgatttgggaccttaaagtattcagccctactctagcaaaaatggccgcatacaggaaaaagagatcattctgtttgacattttgtatctagagagatttagctctgttgcttgttttactgacttgtaagtacactcattttgttctcacagtattttcttagcttttacattctggctactcctatttccacctgaacaaatgagaaatttagttgctaccaatgtctagccttagtactgctctgttctcagggttcagtgtttccttcaaacaatgtgttaggtaataatcaggtctgatacatgcagcatctgtgaactccttacttgatgctgtttgtttttaataaatatggtgtcacaggtcataggtggggatattttaataagtgacactaggatggagtacttactgactgctaggcgcagtgtgccttctatatgtgatctgctttttcccttttacgaacacgatgaggagggtgtttgaattgccatttttgtatatgtaaatagaggctcagagagttaaaaagcttgtccaaagtattcacctaggactgtgctgattaagaatcttagcactaacctaatttttatctggaatgctggatacaattgaaagtttatagttgaggataggaaggaccaaagattggagtcttatcccagatcattaacaccagttaggtcatgcatccttccttacctgctttgtataaaaaataaaataaaatttaaaagtgacactagaacaacgtttgtcttgttaatgtctgtaagatggtttccaaaacgatgagtctggggacttaataaagcaatttagaagcttttgcagtagcagtaacaggaggtgggtgtacatcagtgggaaagaaagatgtggatggctgagggaagaaaataaagaaaaacggatacaagatagagatgattgaattaggcttgaattactcaagggatgggcaagagaaggtagacaaggctgagatttttgcctctaaatccacaaagttcatgcactctgaatgagatttggagcattttaaaaccttttaagttttctattgaacatttttatcctccaaatcattttcttccagtgtgctaagattatagcctttagctaatggttttctctctcagttatgctcctaccatttataagcattaattttgctgaactgatatagtaaaaatgttcaaaataacatttggcagagcattttactctgactactcaagaataacctataatcttttctttttatactacatacacacacaccacacacacacactcatatacacacttacacctgtttttccaggatttacgtctttacctaaaattgtataaatttttccatagtcgagatgtataatttaaccttccctttcccaagggatgacatgtagccatttatttcaataagaaactccaagagcactagtattcacaagccaaatacagataacaccaaaatttttgctaaataaaggtgatgcatccattagcaaatgttgttgcttttaaagtgatggtttatatttaaaatccagtttaagttaaagttaggatatactgatggtttgcacatgatgagtggcagaataaatgagtcaaagttaactcagaggggctttgtttatttttttgttgttgttattttgcttttcctgggcatgtgggtaaatcatctccccagatgtgatgactgatgcttactgggcaacgaagagaaaatgtcacataggcattggatatgtgagtctggaactcaggggagaaataggggctggagttaaaaaacgtagagcctttgtattagttcgttctcacattgctaataaagacatacctgagactgggtaatttataaagtaaagaggtttaatggactcacagttccacattgctggggggcctcaggaaatttacaatcatggccgaaggcacccttcacagggtggcaggagaaagaatgagtgctgagcaagggggaaaccccttataaaaccattaggtctcagaactcactagtgatcatgagaacagcccgggggaaactgcgacccccactcccgccccgcccgattcaattatctccacccggtcctgcccttgacacatggggattattacaattgaaggtgagatttgggtggggacacagagccaaaccatataatccttgttgtggaaatgttatttaaacccacagactggataagctcaccaaaggcgtatgtgtacatggagtaaagggaagaatgactgaactttgaggcacatcatctttaaaagtcgggaaaaggaagatttaacaatgttgccaatgaaggagcagggaaagaagccacaggcagggagagaaatcagaaaatgaggacatcctaatggccaaggcgggaaaatatttcaagaatggagggatcaatcatgacaagtgccactgagaggtcaggtaaaatgagaactgagaattgcctgttggacacttaaggagaatgactttgagctttgtgaaataaaagcctgcctggaatgggtacaaaagagagaagggagggaagtgagccagtgagtacaaacaagtcttgcctttcacttgatcaggaggcaagatagcatattctgctacagatgaagtgaagtgggttgacttggtggtagaaggctaaggaagttctctcagcaagttaactaggtgagaatgaggggtgtgtgtgtatgtagtgccagagatgtggggagagaataaaaggtgtgagaaagtcacccttgataataagatagtaaattaaccaccaaaattggggccgccagtgccaagaactcacttgagggctctaattataaatttatagtaagaccagtcagcagagtcattcgtttttatctgcatcatgatacatgtaaggaggtgacagagatctgctgaaacccaacttgggattttgacaatggaaggacagaagtgtggggatgttcaactggatttatgtaaggtattataatgatgggaaatgaaatctaaatcagctaagaaagaaaatgagagcacgaggaaggttatggacgatggcactgtaatgtattatagtcaatggattggagatcccaagaggtcaagaaacaactaaagtgacagtgaatatactagggtaagaaagcttgaaagttacaaggtagtaaagtgtctgaaattgttatttttggatgtggcgtaataatagataacgatgagttctgaagtatgattaattaaggtaaaatataggacatgaacattggagaatggctggttaacaaactgagaaaccattttcatggttggaccatctacatgcttactgacatcaccaacaattatggcagtagccttatgttaaaatcaatgccagatgccaatatcatcagaggatggtggtggggaggctatcagaagactgtaaatgatggaaaccagaagcattcattgatagtgaagttttgcattttagggtatgaagaagaaaagaaggaaaatgtcttggaagtaacaattcggagcatgaattgtccctatacaaactccaagacttgtggcatgtggagaattaaaggaatagagaacaaaattcatcctttaatagggcttcagagaaaagttcttaggcgccaattgattttctcttcaagaagggaaggacatattcagagatgagattttcatgatggcatgccttgagtgccagagggtttggggagtatagaagatgtaggagcttgagtcccactaagggatcttcaaaatagtgtatgcttatgggaccaatgaatacagttcatctggaacacttgtgttccctgccgggattgataaaatacagggtctaatgggattgagcctattggtctcagttatggtggttcaaggggcagtcggggagggtgtgttctattataatcccattggagtaatggtcttagtccattttgaaaggtaaagcggagttggagaatgcgggtggttagtgatcacctggacatgtggagctcgtaagtaatatgggggctacagcgtgcagagtccagtgggcctacatttgaccttcctgtgagcagtactgaaggctggggaagacaagcctcaataacttgtcagactgagtcaggactgagattctcaacagtaatcagctaagaggtattgctctcctatcctaagagatgccttctttggcaagactgttcaactatgtctcattactaaaggtagacagaatcacttgggagaatccaggatgtggtactgttttgacacggtccaagctggatgatgtaagcaggagagaatgttctaccaaaaaccttgcaacatcagatcttcagctgtgcagccagtcagcacacagaagctaagctaaagagatgtggcatccccacagggaaagagaaagaagcattaggtaagcaactgcctcatttcccagcagtcatgaaggcagttttgctaagccatctcatagcaggttatggatcctgaatttctatgtattcccttagcccagaatcctgctttgcttttatgaacttaccacaaatgatgctcctgttctagagtctaggggagtgattccaaagtctggctgcagagtagaatcacctggaatgtccaaaataaaaatccagattctacccctgaacaattaagtcagaatctgtggggtcctggcttcagtgtttttcaaaagtttcctagatgattcttatatagagccgtggttaagagctatattctagggctcagattctgtccaactcctttggtttgacaagcaggttggctgctgctagaggactaacacttagctcctttctaggactttgcattttttttcaatgattcatagtcctcagactgactatcacatgcatacacgcatacacaaaactgtcctgctgtggtacaaaatgtgtgccttattgagtctcaatccagggacaattgcagcaagtgaagtttccagaggcctgggtatccataacacacacaggcatcccatccttgcagacagttcacacatggatgtgtgatccagtggcaggtctcaagaaaggaaagcttccaaagccaggagcttgactgagacagagccttgaggtcttggactggatctcccttccaggtacacactagaggcaggcagcttccttgtttcttcctctgctctggctgctgtttcattctaagcctctgcagacacattcttcatagctgagaaaactcacagatggaatgactattattggtgcttgtcaatccagaaataaaccacaatttgctcggcatttcaatctttaccactgatgtgttagtttcatttaattagttctgtgctggatgaggtcattagatttgcgtcctaatggaaacctattactcagctctgcatggtgaggagtgtgtaggactgatttgcattatctctggaaagaaggtgaattctctcactacatttgtggtgggcagcaggtcttccagcagaaacccatttgagataacactaattgaagggacacctgtcttttgagaattcttttaaaattttcatagcagattggctgtatgccctgagaaaagggtaaaaagtgtgctacttataaaacgcaattttggagaaaagatgtagtatgatagctaaaactgttacatgaatatcactgagtattttttaagctcttcctcttagaaccaaatttgaacaaattcttcccacacgttcttctagagttcacaaaatggaaagtggaaagtagaaatgaaaccacacctgtttccctcctggagtgagccctcattgaatctctgtagtagtgcctataagagtgcttttattttacaggggtactattatcattttcctttttcagaggagaaaactgaggcttcacactgtgagacctgaggcttcaagttactgaatattttgctcaagtcattgcttgtatcaaatggaacagatggaccccaaacccagtgtggctggtctgaaactttcctctttgtttttatactgcatcaaaaacagtttttcttgccctgatagaatctatgccacttaattctcaaaaccctgtcttcatcacatcccaccattctgaaatattcaccttcccttacaagataccaccatttgaaaatcgcaaaatatttttaaatctatcctctttcttatatattttttatcaagattccttctctggattctggccgtattatgaaaacagcaggtccaagtgtcattgggccaatgtaaaattgtgttgctgtattaagacatggacctaatgatcctggaaagctgagtgggtttagttatgttttgttttctttcctgtctaggacatcatgcaaagctagactacaagaaccagggattgatttcagtgtttctctgggggatggggtaatgggggatagatggtaagtctataatcaagaccatctctaaggaagaggattgatactctttccacgggtgacactgcattattttccatgtaaatggtgccccaagagtactatgggcagtcttgttgcagatctatttcatcttcctttcccctgccctcacctccctgctatttattgtttcccttcactgtcaaattctctgaaacattgtctgtattcaccgtgactcctttgcaatgcactttcactgcaatcctttaaaaaagtttgtcttcctcctacatttttctgataccactttctctgagaaattcaatgtataaatctaccagctcaggaatcccttcttaatttttctctgagactagtcactattttatccactctttctagaagttcacttctttctttatttttcagtttcactttagcctctaataggaggtggttgtctaagggccttgaggaggctgagcttgcacagtgatagttaattcttgttagtggctctccctctctagttcagcatatgctttcttttcctttctcataagtggaaacagtcataatgttctgctgttggatgtttcctggaaaagtctttggagagtttctcttcttctaagatttcagctaatgcactatgtggtatacagcttatctgtatctccagcctccacctctctcaagctctggccttccattggtcactcagtactcactgatcatctccatctagaaagccctgtggtaacccagagtcagccgaaatgaagacaagctcttcatctctctaaatatatttttgactctttatctgtagtctactaacttcatcatctatgcactagatagtagattgaaccagctgtaaactatgtctactagttttgtgcagtggttctcaaacttcagcgggatcaagaccactgtcatgatagcacacattgctaggtcccccttgagaagtttctgcttcagaaggtctggggtgaatcctgacaatttcatttctaacaaggtcccaggtaatgctgatgctgctggtccaaggaccacactttgaaagacacggatttcctgcacaagtctggagccagattgagttaggcttaaatcctaactcagccatgtgcttcatgtatgaatcttggcaaacttacatgaagtctctctgattcctcttctgtaaaatggggacgattaaagtatctacctcatagattttcttgtaaaaacgacatgagtatataagcaaagtgcttccaacagtttttggcagaccctcaaaaactgttagctataattgcacagcgtttactctctctgctttccttgtcctcactcccaacaaccaatcagctctcatgtcctaacagtctgcactctggaatacatccatttccttttcattattgctgtggatgggattaagtgtgtaatcacattgtcattcccctcactctactcatggtcatttaactgattggaactgtcactctctatccctgcttccccagacctcatactgttgtcaggttctaccttaatcactttaaagcaatcattacaaataggtcccttccttgcttagaaagtgaatgttgagtatattaatagggtatttgggactttccttgtactgagggcacctgggctgtctatgcatttcctctcatagcattcatgatatggaatctatgtttttgtaaatgtacctctttgctttcctgcttctgtaattttttacattatattcatttcttttgatatatactccccttcactattacaaggcagagtcttaattcattcttcaaggcctggtcaactttcctttgcccttccgaaggtatagcaaaatggtttcattcctcatgagaatgctgactgattgatggtagctgcttagagagatgacaagaattctggggccacatctacctgtgttcaatcacaaataatatcatggccagtgagcagtatctactgtagacacaggttaaatgcatggatgcatctgtaacaagtattgtctcttacgccatggagtacattttatactgtggatgcccaatgcattttggaaatctcacaactcagtaggcataacctgaattgtcaatgtgagtttcattttgattatgatagctaattttcccttcttcattccaggatgagggtgagaccttatctcagagaatgatattgccagccagaaaatcataataggcaatgaaaataagcctttaccaccttagttcgagaaagcaatatttggaacagggaaaatatattggttgtattggtggctacaggcttaggggtgaggtcttgggttttgaggtatagggaaccagaagaaagaataaggggatattctcccacaaggataaagaaaatcagagggttcttgggaatagctatttatagaggacttccatcatggagaactcctgattttacatgtgcaaggtagaaaagtgataaattccagctctgccacctatgagctatgtaattgggcaggtagttaactttttttgagcttcaacactattatcttaaaaacagaaatcatgatgctacctatcagggcgattgcaaaaattaaaggaaaacatatataaaacactttgtataatatctgactcaataattggttgttgttcttatgaatgttgtatggaataacaatcaagaaaatccccttaaaggtgttaaaactctttgcctcttatcccatattcctatattcaccgttagttatacacacataatgtcatgaagtgtctaaacaatactacaactactaactaattaactctaattgattggaactgtgtaagcaatactgctggtttactgttttcctgcaccaactagcatgagttgatgctgtgaaggtagagttttggtgctgctgtcatatttaatgcattcaaatttaaaagagaaacagcatgaatattacttagaaattcatacctttctaaggaagtttactctcttagattatcacactttataccttagatattttggcttatcttgttcttttcctgatgatgttattaaataccttgaaacacatgggttcataaatattgtaatttattcgttcaacaaatatttttggatgtttcatggggccaaggttctattctagatatcagagacataactgtgtacaaaacatataaacctactattctactggagattatcttctggagatagaatttagacactcaacaagtgagcaaacaaacaaccatgctgcaattttagatgttgacattttctctaaagaaaataagatgatggagtagagatgaccatggtagggtttgggtaatcatttttgaattgtggcgagagctttggccacatttgaattgatacctgcatgatgataaaggatgaagcaagaaaaaaatgtgaattctgagtcctctaagcagcgagaaaagcaagtgatccaactggcataaggactgaaagaagggccagttggtagctaccaggagtttggaaaggagtgttaaaaatcagtgctggaggggctggctgcgctgatcctggagggtgctggaagtcacctagggagtttggaattgcttgggtgcaagagaagccagtgaaacataaagatggtagcaagaaaaataaatttgattttccaagtgtacatgaacactgaatgcctgtagatctaaccttataaagaatttggtggctatttatgtagatgaagtggatactcacctgtgatttgttttctagattcaaattttctcccattgaaaaagcacagggtttacgcctttctactttgttgttcctgaattcaaaaacttttgagttcgtttttaatatattccatgacatattcatgtcatcctgttctctgacaataattttcagtgtggccctgatctgctacattatttatttctttctctttcccaaagctatcttgtgtcctctttgtatttctgtcttttatggacctgagaagatattaacgtagagattttgataaattgcctctgctgtccttggattacttcactttcctttagaaggctcgctatggccttaaaactgtgggcctgtttaaggttattaattcgttccagttcttggggagagcagcatgagcctctgcatgtatcatctggttgaatattctaacaatttaacaattgtcttttcgtctcttgtcccccacactttcaagttggggttgtcttttaacttcactcatagacttggacattcccttccatttcaaatagatgtttccaactcttgtgttatttctcttcttttattatatttgctgtatctacatattttttcaagagctgtacattactcttgactgttctaaattggcatgcctttatgttgacctcctgatcttcacctgtatacattatttgtcccaaggctttgattggctgcttagtcacattgagcacattcgctgaagctctaaagactcttctgtagagtcgacaactgtgtcagttctgtgtatctagtgccagaaaagtacaagggtgatgttttattcatactttgtgctttccttcacaatgacttgttaatttatttttaagttttcttaaatagttacattatttttatatgattcaagattttgaaaacattttttaaaatttaaaatggatatgattgaatttaattataacccacagaattttaatgggccatttgaaattgcaataattgaagaaaatgtttcaaaaatattttgagtgagcttttgaagtctctaacatacagtatatataatatccattttaaaaaattttcttaatgtgttgataatatgtggtttcttttacgaaaatactgtttttcatataaattcctagggagaactttgaaagaataatagtgattaaggaaagcatttaaataagaattaacccaaaagtagaagaaaatcagttaataaaaaacctagtcagagaaaaaatgccacaagttgtttttttcttctttgaaagaactttgatgatattctttcatttccccagccccagaaagaacaaagcttgtaggcgatgactgtgagccagacgaatcttgaaactctttgctcattcctcccaagtatcattcacctacaaatacataacttaattctatgcttctatttggaagagggaagctttaaaattattgcaaacgttcttgcaacggatccagttgcgcctgcctcattttccacctcctacgatgattatgatttcagagtggatttcagaggagaaagaatacatttctcagaaatgtcacttttattttaaaattaaaaaaatcatttctagatgttgcaattaatataaaataacccttcaagaatcataaaaagagaacactgacaaattttctgcaaatgaatgtgaaaaaattttagcatagcaaaatatggtggcagagtgtctacaaagttttcttcccatgctcatagaaacttcactgaaaattcaagactggctggaagattgagtgaactaaaaacctgcaaccttcttctaattctgaattctcatattaaaagaagaattagttgtcagatctagaatgattattagcctttattgctgctttcttcttaaaattttcacagtaagtagtttatttctgaataaaaatgaatgaaaattgctataatctattgtgtttggttattttatgaacaataatatgaatatgatgagaagtgtaagttacaaaaagagaccaagtcaaaatttaagaaacatttcattcataccatttatttagaaacactttctaattaattgaacactttattttaaagcccttggtgctgttagggaactgtaaccaagtccaaactggtaattagtaaaaatattaaaaactaaaattttaaattatttctcaagtggattcattttgttgtccctatgtttttgcatactatagtggtatttcatagggttatttcatcgtcccattaaaactatgctgcagtttccattcattacctcacttgatcagacaagacagaataaacctcttgcccaaagcacccaactagaaagggtgggagctgcccaattccaaacttcatgccttccacttagactagactctgcttcctctctctgaactcagttttcttggactgctagccttttccttttgtggaatattttctctgcctccatctagagtgtcatatgtagtttcctatatggtgaaaaataaaataattcaaaaaatgaaaggaaggttttaaagctccaatacagctttgaatccaataacctaacaatgaatataaacttttctatgatttaaaaagtatacttgtacatctattctttagattatcaatgttgtttagtgtaggtaatgcagatgctcagtctaccatcttgaattagaagcaacttatttattgcttaccagaatctttcctgagttgccaagagcatagagttaggaaattttgtaaacgtttaccttggacagtatctccttaggctgaaattacagtaggtggacagtaacaatatgatctttattttagttctttgatattggaatatgaattttctagaagggtcaaggcacttacatgacctaaaaaattagactctatttgttaataagagtctaacttatttcaaagcaaaaggccagtgaaggatcctcagggctggattaatgtgattttcagcacagagtgatgatggcaattatggtttccaaagcctgggagctgtgtgttttcagatgttggagagggaattgtttggaattcccaattccaaatgatttccctattgtttggagccagtagaaatactgactcttgtcagtatatttatttacaaagctcttgatgtatgcccactttaaagaattaactttcaaaaatcttaaagatataattggagtaagtttgttatatatgaagaaaaaataattctaagagttagaatataaaatgtgcagaatgtaactgtgcttttactttaagtttaggaggaaaacctaaacataacacattcttccaatgatattatgaatcatgtatgtcctgtcaaagaaaatgatcacttaatatgtgatattattaatgctttaatatgcaaatattctgcaaatgtcagtaactgaaggaaggagataaaatagtccttcaaaagttgaacatactcatacatactgtgcataggacacaattttaaataagattacgacctattcatttaatgacaacaataagttcgttttattcatcaataattcattttccaaagtacatatcatggctaaatattatttgaacataatggatacacacgagtaattgtcctgaattcctatataaatctattaacacaaagtagtaatgtaaacagtaaatacactacaaatacctgttcaagaatggccacactcttttaaaatattcatatattttgcatttagtttaaatgaaatctcattctacaaaatttgaataaactggctctaaaatgtacttcttattctcaattagaaatatagttcatgaaaagtgatttgtaaaaactgaaggaaaaggaatttttgtgttttcataagttattgtataattggctgacatgtttataaatccctttctccaggaagatgtaaaggaactcaacagaccaggttaacctgattcttctttgcattgtcacaaagaaatgaaacacagaattaaataaaataatgcaaccaatgttttaaatttttgcagtaaagaggtcaaaggagctcatctttaaatagaaataagcaccatagttttattctaactgcatagataacaatatataacttgtagaacataattttatgagttggtttggtggacaaatgtgtaattcttcttatgtggtcttatgtgggaccattcaggacaaaaaatgacatactgatctttatatttgcaatgcttaccatgtaatacacactcaaaatactttttaattgaacttcgtgtgtgtatagcacagaaaacttatcaaaccttaaaatgtagcagttaaaaaagatagtacatttccttccttagcattaggttaaattttaaactgttttaatttcctgaagtgtcttataaacttttagaattacaaaaaaatgtggtttttaataaaatatttttctccctcattattgaagacgatgttaccatacaactgagatggtttaaacttcagatgctccatagcagatatttgttttttactttctttcatgtcaggctgcttctttcaaattggtcattactagacattttcattgcaataatatttattatttttatgtcttttgaagcctttaacccagaaaggcctctaagtacgttttggatcataaaataaatggaaaaatctttaatcttaaataatcattagtttagcaaatatttctgttgatggttttcactggaacagagcttgctgatatgattgtaagtgtaggataaggccacccagttcagataattctcttccagagtaggacttctaagttggaaaacaataaagactataaggttgtttaaaaccatgcttattttacttatagataattcaggcattgacatatgtattatgtcatttgcaaatgatcattaagaatctctacttgggggatagataataataatcatatctttctcaataagggaatatggtaaaattccagatttagtagtggctaatgtaacctccttttcatggctctattcatgcctcattcctttcctatcatcctccatctaggtcactagcccttgttggagaatattgtatcctattgctccgtgctggtctgcttacctcatggccttaatattgttatgaccttgcaggaagctctcagtattctgtctaaagttgctcaaataatgtttaaatgtgcaatgtttatgctttagctggattccagccacagtgagtaacaagatccacatttttttcttcaccagaattccaggaagtggcatagtatccctctgagggaagcagtgagaaaaatggattggtctaccctcctcagcctttggagagctttggaggagtcaataagatgatagacttgatgttatgaaatgtgatttcttgccataatacttctcatcttcagtaacttcaaatatcaccacacactacacatctttgaggccaaagaaggaggaggtggaattcccttaccacacatatgtaagcagagatgaataggacaaaaattgatgaacgttttggggatggaccaaaacttgcccatcttttgaaatcacgatttacactaaaattagctaaacctccaagaaaatgaacagttacaagtgatggactacatatttttttttaaagcgttcttggtttctttcatttgactgcatgacactataaaatcacacaagctaagaccaggagaaggtgcgtgcagatgtgcttctgacttcttgaagacctacacatcttgctgaggaattctttgcttctttagtgagtggtgctgaatggaatgttagggctcctatagctataggggaaggttattttggggttattagtgatacctggtagctgattcctgattactctctcagactgtcttccctgtttcctctcttctgttgaaaatgttctctggcaggatgatttctgtcaataagagcaattggctttcctcgtcgaggttcgtgcaaacagaattgaaaaaagctgagtgagtgggcaggtttttgctggtttgtttaacaatgatttgagaactgaaactagagctgtctgaaataataaacaggtttctcagtgactggaagagaatggtgttttgttctttgttctggtccttttctcttttgacagtcctatatccttgactgttttcatggctctgtattctatacatggcctggaaatttgactgagggtctcatagctaaaaagtattagaagtcgtggccacctcctcacggagctctcttatttcctcttcgccttgacaacttctgtatttgctttaggtctgaactggaagttgcttccaggcttatcgcccaggtgagttaggtgtctgcttcggtttcctcacacagtattgtcctatgtgcttcttttacgatattgcacagcacatgttattacagtcatttcttcaacgtttgcttcctcatgggactgtgagttgtgtggatacaggagtcatagctactttgcttattgctgatctgacagaacctaactcaatgcccagtagagaaggtctcataaatagtcatttcacaggaagaaatggatttatttttggagatgtcattaccaaataaagccttctaggcagcagcgcccatgctggccatttgactcaaactgtgctgagggaagtatcccctggccttggaagatgagtgtcattttgattccagctctccaggtttttcatcaatgtcagcacctgctgaaaagaaccatcaaactggcactactgctgacttgtttgcaatccttttttaaagtttacctaaaaagaaaccataaaaagcccatcagattgtttttccaaaatccacatagacaataaaggcatttatctaaataatgttttggcttcacataacatcaataaacacttcatgaagattaaactgactgaaaaccttttatacttgtcaactgatttctgttggctgagttgattttctttataaagaatttaaaaagtaaagttgttttgcattaatgcacttagggatgtgtaaatgattttccttaaatcacatttttctgacaacgaacacggagtgaaagattattaaaactgatttctcatgaagttgtttgcatacctcaaacaaatatgtgaggctgtctccatcagtgaatgccatgtgttgatgtgattgatgaattataattaaccttggcaacatgttttacagcttaactttaaggatcaatcgaaattagttattctgaaagtcagtaaaatcgcttctatcctcagcttactgcaataagtaatggcctttctctggaagagttcttaaaatatagtgaacaaatacttagctattgaatctactttttaaaataaatgagagaccaatgggattggaataacttaatttgaaggagagaagtctccaggctgatttagtggctgttctatcaggagtttccagtgggcagggggatcagttctgattaacagttgaggcagttacctaattaaaacagggtgtatgaaagtaagggaagtgggatagtaggggtcagacatctaagaacctctcttccccctatccaatcaaagagaaaagctgaaaaaaatctttattttctgaatgtatatttaatgaaggtggagccatgtataacactaacattatagagtgatattaaatagggcacaagatatagatcacttaaaacaggtgggttcccttaggctcagcatatcaagtgacaattttttttttggtgtgctgccaactggcagagccttttgacaaatgtgatggaccttggaaaaatgataaatgtcttgaccttggaaaatccccttttggaagactttgtcctaaatgcttattcattataccctacagtaatcactgtcaaatatcaaaagatgactccttttatagctcgtgcaaagcttaaatactttagaacatgactgaagatgaccaaacacactctccagaaagttttagtcacctgaccatagcccctatgtttttgatggtcattgtaggcatttggaggtatcactttggacactctccttgaccttttctccgcaaggtctgtcatctccatttagactacacaaaataacgtaacttctctactcactcatcctgcatatcctctgctcccagtagggctctcaataaggcaattacttatctctgtattagcaagggggactctaattgcacctttgcatgaagcatgggcaattaactaaagggaagttgaagctttagtaactctccaatggcaatccatcctgtcctgtgccagcatggccacccagagcagacccatgcctgctttctgcggggggatgtgggatgtttggtcccagaaatattaaaaattactggtgttatctcataattgtagcctgattaaatagatcttattttttgttctatcttttgtgcaaaatggcccttgtacagaaattttctgagatactgaactatggaaataaccctgggattacattggtacttttctggactggaagacttggagtgacatgctgcaatttttaccaagttttgaatagatcatatggcttattttcttttaaatacttgcattgccgtagtgtaggttcctgagctaatttccgtctgggatgaggtatggtcttctgatgtccagtcatgggtccagatggtgatggtaagaaagatagcatgattgctgaatggcatacagaaggaaacagaatttatccctagtaaagagatggataggaacttactagaacaacaggatatcctcttgtgattaggagaggaggtattactcttcagcaaagacctggggtactagataagatgtattggcccggaggaaacaacagaagaagaaatctgttgcacagttaagctgctgtggttggtggttggtgaggatggagaggaatgtggggatggggtggaactgactccagggactcttttaataagactcaacgtaattcaacatgcagcttgcatgaggaggacagggacactccagtggctcctgtaattgagtcctgacagtgaatctaaattccattttacaccaagaaagtctagatggagccagaggtgctttccctgatatggccagatatgagaatcaagggagggcagaggaagatggagagagtgtgccctggcagctatcatctcatattctctggactttgtatttcccttgccccatgtcaggttttgtttgtttgtttgtttttgtctgtatcagtttttaattcatttttacattattcattgaatatattcatagagaaaggattgacagtagacatggctatttgttggatttcttctgtattttatatgtagccttttggtaacaagcaaggtggacatcctttgttttatttcacctaatcctaatactatgtattccaagcctgtgcttatatggctgtgggtctcaaactcatatatctacagaagtcaagcagaaatgtaaatcaggagcaggatagtgggggctgtgtccagctgaaggctgcttgcccagtctaatgaaactgatctagaggaggttgttctagccattttttctagaagtggacacatacgaggcagataactagattgttttaaagaaacattttaattttgaaaacattacatttatttatttatttatttatttatttatttatttatttattattttgtaatctggagggtttagctgacctctgggccaccaattcacctgcactgatgtgattgggagccagtgagagttgtggatctgtgtcttgaaaagtcacttcctttatgctagtgtagacccatcagtagtaggtcacctggaagccagggctctgcgtaggactcagggcagcaggactgaaagttgtgtaacacagcagttaaaaggagggctcaggaccagaatgcctgtgcttgaattccagtccagctactaaccagccatgtgaccagccaagttgatttatgcttctagcctcggtttcctcatgtaaaaagtggagaaaatataagtatgtgtttcacaaggttgttgtgatgattaaatgagttaatgcaaattagcgacaaaggtatgtatgcatcctcactgttaggaacgagggagcaagatgggacatggtggtcccctgagtcgcagtcagtgaggcagctgtgtccatgcctgtgggatgcttttccactagcacctccacaaaatttttaattcgaagggtaggatgagggatctgagattttaaaacacctcccaggtgacttctgcaagaaacacctgcagaggagagagagcttggtcactggggtccgatcctggccccggtgtttactaacagtgttgccttgggctgatgactcatcccaatctctttggtttccaaacgttcactaatgcgatctgctctgtgaggctgatcatctggcagagctcatggcacttaacacagactctacaacacgagttctcctgtcttctcggtcttaatctagtgcaagtctccccaccaagacttgggaaacactcctaaggaaacaaagaggaagaaagtgagatcccaggggtgaagattggatcctttgtgtgcttagttctgaagtggaatcaaatcacttcagaagttggttgtgtgttggcctctggtgaatttgtttcacaatgccatgtaggagtacatccgtggcttctcatatttgtttgcctaactataattgagcagcttgaattcaggctacatttttaaagaaaactagtgatcatattcacatatgatgctctggcagtacacagagtcaagttttcactggaaaatagctattaaaacccagcaatgtaagttttcctatgcaaccttgatttattattttgtcaaatatagttcaacctatatatagccagttaggagcaaaggtgtagggtaggaaatctctagctcggttcctatagtatccaacattctataagaaaacatgcacacacttatcaacaggttttcaataatgaaggcaccatacaacccatgataattatactaaatatactgatgcttatgattttctcatgctgtgtatctggaaggagcctggtgtccagcctcatactgggtcatggaagtagcctgttgtgtctccgtgttctaccatttatcacagggcatcatttctgcatctcgagtcccaattcacaaaattgaaagatctctcaggcctgagcctattgttgttttatctttgaatttttgacaacccagaacatgccacatttcaggaaaggtttcttgaatgagtgcataaatgaagctttgataatgatttgacatttcagcatcttctggtttgctcgtagtttgctaaggaggaaaatgaaaagagagaaagttagagagagcattgcgagcattgcgatttccaggatatacttttataatgagttgttccaatacagactgcaagctcagaactttgaattaactggcacccattgtatgccacctgatgttagtgacaaatgtacccacttcagaacaggagccaatatctgcgtatcagggagctgcagagatgacagtgaaaaggtacatggcaagtgatgaatggtcagatgctaatgccagcaagccctttgctacagagatggagagtttaattgttcccactttgatttcataccgcagacgccataaacatcttagtttaatcaaccagaaacatgggctgtcatagatttaaattcatagcagttatgggtctatatcaaaagctatagagatgcttgttacacacagatacaagaacaggaatggaaagcactgatgtcatccccatgggttaaactggactatctgtctatttttcctgcagggtgaggagtttattaacaagaaacagtgtttatcatactaggcattcagataaatccattttccatttaatttattcatttggaaaggtcaacttttccaccaaaacaatttctgtttctttaatgatttctttaataactttctgtatttttgtttgtatttctcttctctcatttaaaaaaatctcttttcaatatgccaatttaattttagcacacctaatacaaatggcattgaaaaacaggtttcttgagtgtctttttttctttttaaaattattctcatcacttcaccttaggatgttttgtaagcgcatcacatgtgtttcatgtgaacctcactcagtactggatctttttctttccatttacatcctaggaagttattgtttcccattccaatactgtatgcatttttctttcctaattggcgcttgctagtagacagaaaaacattacgtttaaaatccatttggctttaaattaatattttagctgtatctgaattatcccatgaggccatatttatcttggaaaacagattgtggttaaactcctgtttctaacttttatttgtttggctgatgccatctttctgttcagaaaaggagttagggcagttgtctccttccactaggccttgaatagcaaatgtttagccccgagcaaaaaaacataactgccttctgagatgtttcaggctttcattcatgctgtagatgctaattttggaggaagacagaagcttatattcacacagttactaaaagagcacctgggtcagggggtggagactcggtttaccaagttcttaaaagacaacatggctcttctgacttcagcagataaagaggaatcggggcattttcattcctggatcaatcccacttcttgttcatatggtctgtttattgcaccagccattaaccaaacttatgataggaaagtgcagctagtttttcaaaataatgttttaagtcttctttttaaaaaataaccaattcccccaggatataatagtctaattaataaactgatgaatgttataatccattagacagcattatcccgagatggaagggataggtattatttaataggaatgtccagagcagagtttatcagtactttcttgtcacatgaaagtacagttcctggctcagaacacacgccaaggctggtggccagagggaagaaagaagggaagaaaggagggaaacagttgaagccactggctgctttcttctcaagagcatgctttctgttcaaagcacttagtatgtttgcctccaaattctgaactcctatgacttcctgctaaagcactcaccttctttttatttagctttccaaccacaagtcagagctgccctacctcagaatagagcttctttattccttcaaattcccaagtttatttacatggaaggggcatactgctcttgttagaagaatattaagaatatccttgaggttcccaagaattgtacaaataactgttgattctttggtgatagacattctgattttcaacatagaatggctatgcagagtagagggtgtctgttatgtgttgattctacaaacagaagaactaaatccacctgtgtgttcagttttttatacctttatgtcctttatattcccaatgggggtgaggagcgcaggtaggaagggtaagagtctaagaaattgtgctaaaaactcataagcttttggtttcaaaatgatttggcaaaggaattttatcctgagggacctgagtttggggtaagttttaaaggaaaatagtgaaaaagtagcaactatagattattagttacatttaacatttcatgatgggatggtggtgtgtgtgtatgttgacacataatgtgtatgtgtatatgtgtttgtgtgtggatatatgtaggtgtgagtgtttaaggtgggagtcttttgactccagcttttatcattgaatgcaaagggcagaggaaaattcacacagataattcgaagtttgaacatttatattttttgtctttatatctcatattcctaacatgggtaacaatgtgcagacaatttaattcttttatcctcagatataagcatttatttatttttatttacttatttacttattttgagatggagtctcgctctgtcacccagactggagtgcagtggcatgatctcggctcactgcaacctctgcttcccaggttcaagcgattcttctgcctcagcctcccaagtagctgggactacaggaatgtgccaccatgcccggctcacttttgtatttttagtagagatggggtttcaccatattggccaggctggtttcgaactcctgacctcgtgatctgcccacctcggccttccaaagtgctgggattacaggcgtgagccaccgtgcccagttagatataaccatttcttataggaagacacaatctttgttgaagaatactttgaaagaactgcattaaggaaatcctgatctgggactcagggtgtggcacctagggagcaagtgagaagagttaattaaagtactgttatagcaacagaactgggcagtaggaactgcaatgtcactgagaagaggaaggaggataatagctggctgatagagtttgatatgtgtccccatcaaatctcatgttgaattgtaattcccagtattggaggtggggcctggtgaggggtgtttgggtcatggggcaggtccctcatggcttggttctgtcccggtgatactgagtaagttctcatgggatctggatgtttaaaagtgtggcccctgccccacaagtgctcttgtgcctgttttcgcctgtgacttgcctgcttcctgtttgttttctgccatgggtaaaagctccctgaggcctccccagaagccgggctgatgccagtaccatgcttcctatacagcctgcagaactgtgagccaattaaacctcttttctttgtaaattacccagtctcagatatttctttatagcaatgcaagaatggcctaacactcagggtgagcatgaacaagcagggagggtcaaagaagaggaggtctttggtaggagtatgggtcagggagtggggtgagggtgggcagcatcttggaagagggtagataatgcttctctgagatttctaaaatatctttagtttttattgttcatgatctttcttataagagaattatttttggtagactcaaattcaagctgtgttctgggttcaggctggcacagattaaaaactgaagctggtgaaggagtggccacagctggagggaccactgggattctgttttcttgagactttggtcccgacctatatggtgaccattggtccaacataggttgggaccaaattctcaagaaaccagaagacatggttcctccctcaggttgctcacagcatgccatccagtggtcccttgttgatcatgattatcgggagtaaattctgtgtcaacaaagttgacctggctatatttaattcacccccaaatcaaggccagtactcaagtcattttagtaaatttctgtggatgcagtactacagatatgtgattataaggggagccccgatggggtcccatttattcctttatgattaccaggagaattgaaaggcagatctttttttgatgaatgtgaatttctcttactatctgaattgtggagcccaattccattcaaataaattatctatagatttactgaatagggaaaataattttactgtttattgagaggctgttgtatgctacccttttcacttacattaatttatttaatattcacaactctcctgagtggctattataattcttattttattactgaagaaactgaggattagagaggttaagtaatttactcggtattattcggttagtaaatgggaagggcgcaaagctcagaggtgtgtatggaaaagacattgtttttcctgggctgtagagggctggaagtgctttcactgaggctcaggcagtaggagccgggcagcaaggaggaggcagcctgaacatgggccaggatgctgtgccgtgtgggatgtgttcactcagtcaacaaacatttattgagtgcctaccacatgccaggcaagtaggcaaggtatgcctaccacataccacatactgctccaagtagggtggataaaaaagtgaacaaaagaaatcctctagaactcacgatccagtggaatgatgctgtcacaaatgcaatgacactgactcaatggtttgcagcagcacccagaccatctattgttgaggggtttgacattccttctgatgactggcacatcggagcatgctgacttatctgcctacacactgtgttgtgaaacacacgattgtgagatggctcatgagtaatttgtcacattcctacgtatcagaactggtcaacctataaatccacgtttggtcactttagcattaatagacatgctgtaatgactgctggacttgggcacctcttcccaccttggacaatgatttgtaagcacctgtatctttagtagaagtgctgccacttccatccttgatggccttgatggcatctttccaggagcactgttctcttctaagtccatgctgctccctgtacttcttggcttttctgtggtataaggtcccagggagggtaggacattgactttttctctaactctttgctttagtttctaaacctttgtctttgacttcgctttctgattccacccttcacgccatcagctctagagacaaaggtaacaggacaaagaatcagggaatgaggtgagtagtacctgtctctctgtcccccttttctccccctcctcaggcaaaatcccttccctccttcagctgcaatgagacatcagaaagggccaacgacttactagttatcttgtgatccatttaggaaaagagcaaagtaattgcaccatggttagaatactcagtatataaacaagaattcaagttctaatatctgcgatagacttattaaagaaagaaataatagtagattagattgaagtttatccttataataacttgtctcttgctctcttgcattcacatttgttttcttgagatgagataaaagatttaatttactgagaatttgttatgtatgaaaataatattcatttcctccagcctttcaatttttttgtcacgaagttttgtataatatatacctttatagacatattttcatcttttctacatatgtgggaatgccaaatgaaagccatttttcctcaatataacatttttaacaagagttcttaaaataatgattccccagttaatgtatacatatacatttgcaaaatagcaagttcatttggtaattgcagaagaaataatggctttaataaccactgctccacttggtgtctgcctctaagcattgttaggacagcaagcatcaggcaattccccatggccctgttttctgagaaggttctatttatgtcttccgaattttgactatattttgacattttcaagtaagtgtatggcatctgttgaataaatgatcactcaaaatggatttgcctcaattatcacctaggctttaatctctctaactacaaactcccccttcctcactgttgctggcagtgacacctgcattcctgctgcaccgtcatccttgggaagggctttggagttgcaatcagcatccttaagagaagagtacttaggtgtagtatgctttggctgttctcataagtcgttattggtcagcctgaagcctcactgttacaattactttgtctaattatgatttttgctgtcaaacttatgttaaaatttcagcaataacagtttatttgttcagtgctctcactgcattataaacatgaagttttcacattttgtatgttttagtaatcatgaatgactttctagtattgtccacattatatatttgatatctatttatactgcgaattaacactgaaacaatgaactaacgtgattttcttgaagacaacacattgtgttcagttggttctctgaaccctaaataaagctgaaaagtgtattaattttggtatggattccctaatgattgcacagttacttgtatatattttatagctgtaaatcttggtggataaactagaattagcagtgctcaatgacttcaaatgattttttttttttttgagatggagtctctctctgtcacccaggctagagtgcagtggcgcgatctcggctcactgcaacctccgcctcctgggttcacaccatctcctgcctcagcctcccgagtagctgggactacaggcatccaccaccacgcctggctaattttttttttttttgtatttttttagtagagacggggtttcaccatgttagccaggatggtctcgatctcctgacatcgtgatctgcccgcctcggcctaccaaagtgctgggattacaggcgtgagccaccgcacccagctgacttcaaataattttaaagattatacacacacacaaacacacacacatacacattatttttcttttgaactgaaataacacctggtttcaattgttatacatgttttctcagctagtgctattgcagttgaaccataatatatataaagacaatatgtggatcctagaggtaataaattatttcagcaaggttgtagagtacaagattaacaacacacacacacacacacgcacgcaccagtcacatttttatatactgaaaatgaacagggaaacaaaaattaaaaatgcaatagtatttataattactccagaggaaaagacgtgattagatgtaaactttaaaaaacataatctgtacatactgaaaatttaaaaatgctgacaaaagaaataaaaaacatcttaaataattggagagacatatggtgttcatgtactggaagtctcacatagtaaagatgttaattctcctgaaattgatagtcattcctataaaaatcttagcaagatcttttgtagataagcttattgtaaaaggtgcatgacagatcctagaatagttaaaacaatgttgaaaaataataaagtgggaagaattactttgctgaatattaagcttattatagaactacagtaattaagacaatttggcagcgagagagacacaaatcagttggacagaatagaaattctttaaatagattcacaccaatttgcccacatgatttttgacaaaggcacaaaagcaattcaatgcatgcaggatacaagtttcaacaaatggtcctggagcagtcagatattcataaggaaaaacaatcaaacaaacaaaaaacccaactgaacctccacataaacctcacaccttatataaaaatcaactcaaaatgaattatcggctggaaacataaagctataaaacttttaagaaagaaatacaagagaaaatttctgggatctagcattcaacaaagtgttcttaaacttgacaccagactcaatacataaagggaaatgttgatgaagtctactttatcaaaatttaaaatgcttgtctgagaatgagcttgttaaaagaatgaaaaaacaaagtaaagactgggggaaaatatttgcaaaccacatatctgatgaagaataagtatttagaatatataacacagtctcaaaactcaacagttaaaacgatcccattaaaaatatggaccaaacacattgagagacatttccccaaactgaatatagagagagcaaataagcacatgaaaagatgttgaacattattatcattaggggaatgcaaataaaaaccacaattgatatcaatatatagctatcataatggctaaagttaaaaaaaaagaaaaaaggaagtagtgacaacaccaaattctgacaggcatgcagagaaactggacctctgaaacatggctggtggaaatatatttggtacaaccactctggaaaacagtttgccaatttctttaaaaaaacctatccatgcaaatatcatatgacacagtacttgcactcttgcatattaacccctgaaaaataaaaagaatattcacatagaaacctctacttaaatgttcatagcagctatagtcagactaaccaaaaattaaaaacaacctagttgttctctggttgttctttggcaggtgataattaaacacactgtggcacatgtatattgtagaatactactcaataaaataatgaactgttgatacagtcaacaacttaaataaacctagatggaattaatgctaaatttatcaagccaattttaaaaggtcacatacttcatggcaccatttatataacgttcttgaaatgaccaaaatatagaaatggaaaacaatgtgtagtttccagggtttaggcaagagttcagagtgggagggaagtgaggaagcttataagagggatccttatggtgaaggaatattctgcatcttgagggtgtcaatgtcaacagctttcttgtgacactgcattatagttgtgtaagatattacctttgggagaactaggtagagctacatgggatcagtctattatttcttgcggctgcatgtcaatctgcaattatctcaaaataaaaaattgaattcagacaaaagaaacaatacatggaggaggcttttggcccctgtgggagtgctctcttgattctcctgttagagagagaactgtcttttcaggtacaagatgggctcctcagcctccgtcccagatggtctacgttgagttcaattttttgttaagtcaagaagatctgtacttagacggcagtataaatacttggcagacactgcaaaaatgacctcagtacatacaatatttgtcagaaagcttgcttggtatcagcattgttcagaaaaaaaaatacttgaagaccacaattctaaaaacttatctctagagcaagcctagagaggagagaactgagtgcctaagttcaattattattgagccatcatgaaattgtgtttacagaatcacactttggtgatcctagaagaaatatcttcctttagtcaaagaatgataaaatttctctgaggcattaaatttcctatgggaattgtgaattatatgaccaatttttctccttctcttaggctactgaaattctacagctaatttgatttattctgtagcaatgtgggggtcattatatatgattgttcaggcatgaccaactatttttccttggttccccatcttacctttaattaatgtatcttgttaaagtttctgagtctttagaagctgccttaaatctctatgtgaataaataaggaataaagataaatttatcttgatgtacctgcttcagcctcttaatatctcgtaattgcataggactgtcctggaagcatattgaaaaattaaaacaaaaaaagacttctatttctggaatttttctatgcctccttcaaccttgtatttagcaagcatatttttgcaatttttttttctttctctatcttgacttcctctctcttgttagccctctgatgaatgggccagtttgaatttgctactctggtttttggcctttgacaacctgccagcaaatgccccgcttgtcctctcaccaaggatgagaagtatcccatcctatgctctccctcagctctaagggatttactcaaaaagagaaagagcaattaggccctggacatgcattctaacttaattttagcctcagtcttctctgatggaaaccatgctttaaacatttcactccccactaaactcagttcatatcacaaatcctcttcaaaataacagatttatttaaccttaagtaaaattaaccttggattgatccgaggtgaataaagcattttagttataaatggaaagcattgagtctgccatttctagacccatttctaagatgcctaggatgcattagataatttatataaagtgatgttgtgtaactaataaacacatattctactgatgaagtgtgtgtgtgtgtgtgtgtgtgtgtgtgtatgtgtgtgtttgaaagtttggcagttacacatacagtcatatgccacctgccacctccgtattgtgctgtaagacttcttcagtcatccttaaggaagtgtttgatccctctttcttgttacatataaagacaatgcactttaaatactactttaaaatctgcatcagcgttatatgcctgcttggccctaggctccagcttcaccacatgattttctctccaaatgaaatatacacactaccttgggttcttctgtgatttttcctgtctactcacatttctttatttttcactcttggaatatctgaattcatcatgcataatttctgctgtttcatgtacttgaggaatgcaaatatttgagatctgcagctacagacaaatcaatagccttgtggttccatttgttcccttctagcttttaattctgatttttgacagtttctgaatatggtaagttatagccctgcattactaagagcaataaaatataaatatatcaattcctaatgaatttaaataacttgtgaaataaatcaaggagcccggaaaatttaaatgataaaatttaaggatgagattcatgtgctatttgctgactaatgtaaaaaaaaaattcaacctgtttatgactaatgttaaatcttaaaatttaaattgcacatgaccttggtctgttttgtttcactatgattatgactaatccctcccaaatttataacagttgaactaatgcaatgttgactgtcaacagttgaattcctaaaacaaaaataaatatgactcgtttcatttaagatgtagatgggattccatggaaaaggacaaagatggatgattatgctgtaatagaattggttggttgccagcgataagcttcaatataagagtggcaggtgcattgtagtggaatgaacaatgagcctagtgtcaaaatctctaacagtatgacctcggtggagcctgtttttgttatcgagggtacatttttaatagatgagcccctctggggtcttgagtaaagtgaagaatcataaacacattcactattagaatctgagggactctgtcatgtcgtcttccataccgctggagctgggtctgcctagttcccgaaatggacactccaaaaatatcttataggaaaaataaagaaaattctttcttcctgtgaaacctttcagccctctccaattattgtcaaatacagtgattttattcaggaggattcagtctgctattttaacctctggctttaatgctaagtattctagcctaatatttatactatgtatattttctcaacgtcatctaccagtcagtagggtaccttggtattcattttcttctgaatttatttactaattcaacaaatacttattgaattgtttatgtggcaggagcagtgctaagttctgagaacccaaaagtaaaaaaggacaaaaaaaacccctattttagggagctttaaaaattacatggatacatgtaaaattactatagtaagtgctgtgaagaagagatcctggtgcagtctatgcatataatggtagcttttactgatcatggaggtgagaccaggctttcctgaggaagtaattgttcaccagtatctaaaggatgagcatgagtaactcggtaaaaggttgggcatgagcatttcaggtgaagaatatgacacgtgaagcagtcgtgtgtttgagaggggtgtggtaaatgtaaagtcagtgtggccgcagctcagagaggaagaggaaggctggagaagtagtggtgctactaatgtttaaactcgtcccaaaggcaatgagaaaccatcaacgtttattaggcagggttgagagtgggtgaagtgacatgatctcttttgtatctgacaaaccatccttccttgcatgcggagactggctgccttggtggatgcaggtggacaaggcagccagtggagtggttgagagaagagatattcacggctaagatgatggtggtggtggaggaaagcaggtgacacgagtttttattggaggataaatttgcttaattgttaatttaatttatttttattgataaatagtatttgtacatgtttatggggaatatgtcatattttgaccatgcatacaaattgtaatgatcaaatcagcatattcaggaaattcatcacctcaaacattcatcacttctttgtgttgggaacatttcaactcttttcttctagctgttttcaaatatacaatacattgttgttaactacagtcatcatattgttctatctaacatcagaacttattccttctatatgagtgtatgtattttttttttttagatttgggggatatatacatatatttgtttgttaaatgggtatatttggtgatgctgggatttggacttctagtgaacccatcttctaaacagtgaacgtagtacccagtaggtagttcttcaaccctttactccctccctcctttcctcccctcttttggagtccccattgtctattgttttcacctttatgtccatgtgtacccattgtttagctcccatttatacatgagaaaatgtggtatttgattttctgttgatgcataaattcacataggacactggcctcctgctgcatccatgttgctgcaaatgaaatgactttattctttatggctgcatagtattccatggtctatatgtaccacagtttctttatccattccactgttgatggatacttaggttgattctatgactttgctattgtgaatagtgctacaataaacataaaaatgcaggtgtctttttgataaaacatttttttttttcttttgggtagatactcagtagtaggattgctgggtcaaatggtagttctattcttagttctttgagaaattgaatttgagaatacatttagcagggcttggagagtgggagtttaggaagctgatggtgaggatcagggcagatgactgccagtattgcttggaatatgtaaatcaaccattggagaggagggcaacatgtataacattataggagcttttgactggtttctctgcttagtagggaagaaaattcagaaagaacaagtgtagctccccgattctgactaaattcacccataagaaagcccctaaagttttctgacccttcactttgctgatgtattttatgcatatgaaatgatacaggtgaaaactctttgagatggatcataatgtataaatataggttattataacatattataaataattgtattacattttatatattaagtatacatatgtatataaggcatatgtgctattgcacttttttattgtatacattgtattgtttttttccttcaagaagttcatagaatgacaatattattttgtattaagaaaaaatctggaccaggtgtagtggcttgctcctgtaatcccagcacttcaggaggccaagacaggcgaattgcttgagctcaggagcttgagatgaacctgggcaacatggcaaaaccttgtctctacaaaaactgcaaaaaaattagctgggtctggttgcatgtgcttgtagtcccaactactggagaggctgaggtgagaggatcacttgagtccaggaggtggaggctgcaatgagctatggtcttgctactgcactcaagcctgggcaacagagtggagattctgtcaaaaaaagaaagaaagaaagagagagggagagaaagagagagataatgacagagagagagcaggaaggaaggaaagaagggagggagggagggaggaaggaagagatggagggagggagggaaggaagggagagagggaggaaggaaggaaggaaggaaggtgtggaatctaatcctcagatctatttcttaactatctaaaagtagtgtgttaatggtgtgatgcttatttattaaaactgaatgaatggatggtaattttgttaacatttagcttttaaaatctagtgaatatatgagctcattttactatataacacatttaacatttataattttattaaattgcaaacagactcgtaagtagacttttcttctctgtacctttggcaacatatttagaaggcagttaaccatccattgagatggaatataaagagtaagtctgaagtttacatttagattttgacagtcatcattagattatgcaaataattaaaaaaaaaccttacctcttgctagtatctgtgctcagtgtccttccaactccattcctttctttcatgttaacatatcaaagccaatgaggaattctatgctgtgcacagaatgccttgtctacctatggcagcaagggccactctgggatatgatatagtggaaattaaagaaaaatctgcctttactccagttttaggatgttttgaggagaggaatgtagattccatcttctcatacggaggtgttcattggggttgtgggagaggccttctgtagaaagagctgaggtcggctcctcaaggagttggcatagcaggctgcccagaataaactgacacctgatagattggagtgttcagagagatggaggcttccatggttttctgaccctggaagtatattgagatccagtgacatgccgtgggcccaaaggggagcaccccacccaccatggagattgggtttaaaatgatgggtcagcttctagacaaaagacctggcaaaaacttagggatctgcagccaagtgagaggcaagaagagtggctgagtcaaggatgacaagagggctgatgttccctgaggtcagaatggttgacaaaataagggattggagtgctgttctaagcacttaacacatatttagtacacctaatctcttttcgcacctatgaggtaattactcctaaaacttccattttgcaaatgagaaaactaagtacagaaaggttaagtaactttctcagtatcacacagctaataaatggtaagccaggatttgatgtagaaatctggccagcaggctgtgttgcaaccactatccatgagcacaaaatccacgagccatagcgaagaggccagcatttttaaaaatggccaagtggaccagggctccaatccagccctgttttttttttttattgttgttgttagtttgttttgtttttttgaataatgctttactgaaacaaagtcatactaattcatttttgtattgccagtggctgctatcctgttacaatatcagagttgagtagttgtaactgacaccctgcgggaggcaagacctcaaatattcagtatctagcccttgcagaaaaagtttgttgactcttgacgtgggcaaaaattatcaaaaccaccaacgagaagcactcaatgagagacaagggaattccccaattccaagggatgcaaaaaaccatcaatgtattttagatgactttttatctgtagaagcagaagagatcattttatccatgggcaaccccattatacctgaaaagacatttaactactggctcggcctaaagtgtaaactgtaaaccagattggatatttaatcaaggggctcagaaaaaaatgacaggagtacacgtgtacacgcacacacacacacaccatgtgtttgtgtatatacacacacaaagaatgtcaactatatatacaaataaagaagtgtaaacacattgttagtttggggattaatatttgttatgagttagtatttgtcttatgttaataaagaaatatttatttgagatacctgctgaaatattgatgggtgaaattgatatgctgtcctgaatttgtcttattatagcaaataaaatataaaatatgtttgaggagtatggtgcaaaagaatagctaaattaatgatcattgttgaagctaaagtgattaatagatgatggtttcttataccattccttttacttttgtgtgtttgaaaatacccataatcaaaagttttaaaaattgcaatgtaaattatttagacagttttcatattttaccatgaagtgaatacagaaaaattaagtgatttcattacactcttgccataatgttcatcccttattttctttgtactatcgggaaagaactagtgaattggttcgaggcatagctaagaaaagaagatgagacacctattggggagttaaaaattacttaacaaatttgttttgccctgtttgccgtcaccacaaacatgaactgaagtgcgaggagtggcaaatggtagggaaatttatatctacagaaaatcacaagctaataaagagttccctaatggattctcttagattcccagtaggtagattatgaaatggttgaatttcacatcaaacccattggaagggtggcagatactctctgagttaaaaacacacacacacacaaaaacacctttcagcctggtgcagtggtgtccacttgtactcctatagtcccagctactcaggaggctgaagtggaaagattgcttgaccccaggagctcaaattcagcctgggcaacctaccaagacccccatctttaaatttaaaaagaagaagaagaagaaaaaaagaaaacaacttttaaagataatgttcctgtccttaaaatgaggagattaaatgtgcattaaaatatctcttgcagcaagtaatttggatatatttcatcaatatgtaatatttgtgctgtgttttaacagtggcgtgtgacatctgttgaaataaaagttttgttatgtcagtcaagctgacagtaaaaagactgcagaacagttttctgacatgctgccctaccaatttagccctggcactataatttccattttgatttccaatttgatccaatgattatgcattcctgcattcttaattttcaagtgtttatgatttctcgatgtattaaaatatttatgtctctatttgaagaactaaaattttctatgaataaatagccatttattcttttaacaaatactgtcttgtgccaggcactgttgcaggcacgacagcaataggaaggaacaagacagaatcctactcttttaaatgaaattgctgctatagtattcactacaatatagggtagatgaatttatctacatcctagtatggtttctgtttactgatactaatctattctgaaagaagcaaattaaaatctcccactacaattatttttatcacattttctttgcattttttgatttatacattcagtttccatttttatttatatgtatatgtatacacatatattcctatatatatatatatatatatgtaaatagttgcctttatttttaataaagaagcactttaccctgattgtacttttaagcttaaattccaccttgtctgaccctgatattgctaattatgttactgttactaacttttgttttggcctgctgtattgttgcccaggcctttatttaagctattgatcatcacatcacttttttgtgtatttctttttggaaataacaaatggcttggttctgtttaacaatcttagttaatagactaccttttgatatgaaaattgactccatttagagaaaaggtggcaatatgtgtaatttttctctttctgtttattttatgttatactttttactgtatgttttcttttgccctttcctattttttttttcaacttggtcaaaatactatttttattttcctacttgattgtttagcagttctgtttttgactccattaaaggttaccatctgcagcagaaaaagttaatgtagtactttacatgaaatttttgctgaaacctgtatttattttactagcattacttatgtaagaaaggaagaagttattgcaaaaaaaatctatatcatacccacagttgcatatagcaatttatattaaagttaattacaatttaaacgtccattcctagccacaatttatcagtaatcatacgtgtttgttggctaccatattgttaatagtgcagatttagagaacattttgatagtcacataaaattctgctgaacaataatagtatactttgtataaactatatataccatgtatatactttgtatactataatgcatacattttgtaagtttgggaggtaattgttagtaggttaaatattaatgattaataaaaagttcaatttcctaatacaaacatgaaagggcaatacaatttcacatcacagaccttttaaaataacatcagagtttaagtgaggattatttaacaataaattatttaagttaatgaaggatatcccaagagaacttcttgcaaacaaactagccaggactcaatttcacgatgacaagatttcgagtaactttaaatgtgacaagaaaggacgtttgccccaatgtgtctaatgcatatacacttaatgtccttaagatattggacttgtaaatagtctgaagcttttgccattatttcaataatgggtcctagtgtctagcttaaggcaatgtattcttaaggcactggtgtcaatggtttttctgttttttaagatgattcattatctgttcaatgaaacatgtggcctccagtatcaaccacaattttatctgaagttggtgacaatttggaaactctacattgtatttcacttttctagcattaataatcaaacacatatctctctactattagatggaaatatctctattttcttcaccaaatactttcaaggctgtttctcccactcaagtaagataaactttaaaataggcttgatgttcactccatcttccacctcaaagcctgggttttattaaaatagttcagtagttctatagtccagaatactttaagattatcctgtcattacacctcttaatttgaaaaatctcatatatttccagatagcctatgcttattcatttacatactactgtgcgtgtataaacacacacacacacacacacacggaaggacacacaacctaccactcttcccccttatcctctccaattcatctgaggactctattatgatttgagtggggaggtgttcttatatcattccttgaatattgtcatctgatgtggtcagtgactgataaaaatgtttaaagtcatagtctttgtaattacaaaattagaaaaacacttaaacactgttaattagaagatgagtataaatgcgctgggtaaatgtgctgggcacggtggctcacacctgtaatcccagcactttgggaggccgaggtgggtggatcatgaggtcaggagttcaagaccagcatggccaagatggtgaaaccctgtctgtactaaaaatacaaaaattagccgggcgtggtggcgagggcctgtaatcccagctactcgggaggctgaggcagagaattgcttgaacccgggaggcagaggttgcagtgagccaagatcacaccactgcacaccagcctgggggacagagcaagaccctgtctcaaaaaataaataaataaataaataaaaaagaagatgagtataaaggaacttggttccttccttatggatgtttagcttgtttaaaatgttgctatcacaagcaatgtaacatgaatgacattgtcatttcctgtgtaggccagtatgcctaggatacaatcccagaagtagaattggggtataagagtgtgggtttgtatatttttattagatagtgccaaattgttttacaagggtttctacaatcaacatttccactagaaatatatggaaatccctgtcttcctgcaacaattttggaggtttggatttttagagccaatctgataggtaaaaaattgtatcgctgtgcaatttaaacttattttttcttattttgaatgtgactggaatcttttcatatgtctaagagtcatttgcaattgctgtttcataactttctatttcttagcccatatattttctctgaccattgtctttttcttgttttccgggagcacttgacctattagaaacataaactctttgcagagtaatttatagataaaaattatttttccagtttatcatttgtcttttgattttacttgcagggttctttttccactgagcattttgaaatatttttgtagttgaatttatttcttctttatttttcctttctctctttctttcttttagagtttctggattttgagacattgtactgtattggtcaggataggtgaggttatgctattcctagctcatgtggttgttggcagaattcaattccttgcagctataggactgacatccctgttttcttgttagttgtcagcctggggctaatatgaattcccagaggaccatgaaattccctaccatctttcttttgattaccttaaaaccaactgatcagtgactttaattacatctgggaaattcttttactttagccatataatgtaatccaatcatgggttgacattccatcatattaacaggttccctctatactcaaggggagggattataccaagaatcttgggagctatcttaaaatattgactatcacagatcttcttgaaatttctcatcttctggtttgcatgtttattaagtcatcagattcctctttttttttttttttttttttttttttttgagacagagtctccctctgtcgcccaggctggagtgcagtggtgcgatctcagctcactgcaagctccgcctcctgggttcacgccattctcctgcctcagcctcccgagtagctgggactacaggcgcccaccaccacgctcggctaatttttttgtatttttagtagagatggggtttcaccgtgctagccaggatggtctcaatctcctgaccttgtgatccacctaccttggcctcccaaagtgctgggattacaggcttgagctaccgcgcccggcccaagtcatcagattcttaaagcaggtttataatgtattttaatatctgataggaccagctctcttgttgcaattcactggcttatatttatttgataaaatttccatatgggttttagaataaacttaccttgttcaaaaacccctttagagaattttataagcatcatgataagatatacatgttaacttatggaggagtggcatgtaagtgatggagaggtttccttttcaataaaatattgaatttccatttactcagactcctttggtttcaattaatagctttttaatttttttcttattatggttcttatgttttatttgttttgagatattttatctttttgttttgattacatgtggaatattttactaatatatcctataggtattattattttcttaaaagcaagctactgaattcagcatattcattatatacagtaatttttcagttcattctcttggattttctacttatacaattctaactgctgtaaatagtgacaattgttcctcctccttaatttttttgtacatccaatttctttcattttctaactgactgctactaaaatataattttaaagaatactggtgactggggatattgttttcttcttctcaccctagtgggaatacctgcaaggtttgacattaaccatgaagctattctaggctgagagagatatatttatctgggaaaagctagtatccatctgttactgttttattgattttttaaaaataaataattattgttgaactatgccaaatgtattttaaagcatcagttgagatgattacctaatattccttcttgaacttattaatatgactttatataaatagatctttgattattgaactatgcttggattatttgtattaacacttgatcatgatgtattattctttttacatgctgctgcattcagtttgctgatactttatatggggctttcacattacaattattaggtaatattggtgtataatagatcttgatcaggtactggaacgactattaataaaatatttttaaactaattcaaaaagtgttcttttatagtctaacactgtttgaataatatgataatctactttaaaagtctggcagaattcggccgagtgcggtggctcacgcctgtaattccagcactttgggaggccgaggcgggcggatcacgaggtcaggagatccagaccatcctggctaatacggtgaaacccgtctctactaaaaatacaaaaaaaattagccaggcgtggtggtggtcgtctgtagtcccagctaatcgggaggctgaggcaggagaatggcgtgaacccaagaggcagagctttcagtgagccgagatcgcgccactgcactccagcctgggcgacagagtgagactccgtcttaaaaaaaaaaaaaaaaaaaaaaaaaaaaaaaaagtctggcagaattcttccatggacacattccatcctattgctttttttgatgggacagggaagggttctttgacaacttcatatattttgtctgtttagattttgaatcttcccttagtgagttttggtaaattgtgtttttctagactattattcacttcatcaagctgtagctctatgaagttttgatatccagtaccagtctttaaaatacttgattttaatttgcaatttcctctgacataaagttacaaacttaattttttaaattcctagttgtcttctcggttagtcattaatttcttattttatcactttttttgaagaatactctgtgcattttcatatgttttgggtgctattgtcaatttttgttaatatccgataggcacataaaaattgtactctctattaaagggcaaatgttttatacacacacatatatacataatgataaacatataggtgtggtatgtgacatatctatatatgtcaatatgatctatcttattatttattcttttccatatttttaagtccttttattcacctgtgtaattatctgtgagagataagttaaaatcgctcattaaggaagaggagaaaattaacttggttctttcctgttcaaactcatgtttacttttatgattaagagacagaatttgacatgaagtcactggttcatatttttttcattgtgtatatcgtaggttgttacattatgtggagaaatccaagattagtatgatattttcctttttaaaaattcggaaagatatattttgggcaatgaggccaaaattatcaagtcatttaaaaattccaagactttaccaggatgtttcacagtgttgactatttgaaccagtttcctcaagcactaaaacattttcaattttgagtcatcttccttatttttcaacattttcttattaaaatatctgtaatatttattaggttggtgcaaaagtaattgcaggttttgccatgggccatttttccctccaatttcatcttttttttttcctgtcatttaaaaaaatcttctattttaattattttccctgaattttgccagctaatatttagatggcatctctggatggtttcactatttttttcacatttttttttacatttatgctgtgtaggtttttttctttataaatgttattacttcgttaatttattatgaattcttagctaaacatttggatacttttgctttatatcagtatttctcacttgtgagtgatctacatcaaatgataaattccaatgctatttttgatattttttcttaaaatattataaattctacttagtttgagggctacttcctcaaaatctcatctcttattccaaacaagaagtatagtttttgaactccgagttggccccttatcttcaagaaggcattgatttattgattgattgactgattgagacagagtctccctctgtcgcccaggctgaatttgggatgacaggcacacaccaccatgcctggctaagtattgtatttttagttaagaggcagggttccaccatgttggccaggctgatctcaaactcttcacctcaagtgctctgcctgccttgacctctcaaagtgctgggattacaggcatgagccaccatgcccagccagaaggccatttttgatggggctctctgagatttttctgcttctgggctctcttgtaatatcccgtatggcttctacttgattcagctatttttggaagcccttactgatatttttgaatatgcagattggaattgtcacctaatgtccctgaaaatggattttgtgtatattaacattgtttgtgctgcatctttatgattaccagaaaaattatagggaaaaactagacatatgcagccatgtttataccaatattcctcctgttttttagttcaagtattaatatgtaactctcagaagctgtattttattaggatctttcctgaatgttccacttgctctgattttctctggctgcagggcttctcacatgtgctaggattttcttttctcagctctctgggactcaggctgagctccaccgtaccttaagctagagccgtgcggtgggtggcaggaagtgctgtggtttcctccacctgatatagtgaaagcagcgtgggttctctactaaggagccaggagaagcctctgttttccttctcttccagaggtttcagcctaaggtataaacaagacttatcactggtttatctctccctcaactgtttggaagctactgaaatcaggtatactcatatggaatgataccatcatttttcttcttgggatccatactttaatgcaagacaggtcttgccaatatccactactattgccctccccttggaattctccatcattaattcctaagatcccgtcaagctctgaatagagaagctttcgggactgaaggagagcacagatgtatttaagccacgatcgcccattctccctcctaattttgcctatgaatgggttttatacaaattgttatgagattgaagaactagtgaaaaattaattggtactagtttttaacacacttctctatacttataaacttccaggggtgaaatttgaaaggaaaatatttgttctgccacttgtagtatttcaaagtcttgcagtattttgaagtctcctagttacattgagggtgattatacttcattttacaaattgctttgcattacaaaaaaaaaaaaataggtttacagtctcttaagaagcccttcactgattggctaatggtttctgatggtctgtagggtctaaatttgagcatctgggagaataccactttctctatccaagctgcctagctgcagggaaaagagggtagacagtagcctgacttccagggaaatcatctgtattgcaggttagggccaaagtaggtcagtaagagtagggaggctaaaaaattgactgaaacaaagaggtgagtagcaagcaattattaggagcaaaaacaaagtcctggaatcacagtgtcggggaggtaaggatccagggtgaaggtgtgagcaggtaaattggaaggtgttctaagccaacatgtaaactcagcatctgccaatgcaatttctcccaatactgtccttccttgaatgtttgttagcttattattttaatggcaacatcagcttcaacctctccttgtctcttaacccacttaaacaatatgtggccattctatctccaaattatttccccaaccacactccccttcctacttttgctgtaacttccttttccatcctccattatgtctcctggaaaattgccgtcattcccttaactggtttcttcagaagcctccagtctctccctcccatccatccttctcaatgctgtcagagtaatcttttcatgtaagagtgacctccaattgtaagcgcgacattgctgcaatatcatttatctccatcattattgcagtttgtattttgcgattggaaggatggggcaggcaccaaaaaggtgatgtgacttgtgctgtattttccgagtaagtccaagaggtgaattatggatttttctaccaggctgactcaggttgaatgctgttcatttctgggtttgtgtctattatcctgcaaataacgaatacccctaaaatgttagtgtgcaattatgccattgggatagaataattctctacaacataaaacagtttttatacaactatgaaagtagtctggagatttcaactttcattcaaacaaaattgaaagaaaatgaataacgttgagacaactgagcacaaaagaataatatcgtattttccaaaatatacacatcaaccactttaggctattgtatgtgaaagggccgtaagggtagctgggtagaatatgcccaaaatttcttccaatcatttttttttcattgcgaaataccgtaagaactctatccagggagggcgactacatttttggcagggacaagatacaaaaactagagagatagttgttcattctttgagcagcaataaaaaattcagtcttgctctctctcttcccctctcttccctctctcctctctccctcattctactcccttagaatacttgtaagatgtcatatgtaggtaaaaggaatacatcatcagacaagtatgagcactggaaattagccaatgtagccaaacttggggaaatttatgtgttgcttactctaagattgaggcaaatgagagtgacagttctttccagctcctcccctgattactgatgaggtattactctctgagttgctctaagattgagccaaatgagagtgacagttctttccggctcctcccctggttactgatgaggtattactctctgagttgctctaagattgagccaaatgagagtgacagttctttctggctcctccgctggttactgataaggtattactctctgagttgcctagtagtaaagaggaagtgcggtcatctagcatcattcaggaggtgaatttataatggttcctcattgtttaaagcaatcttttatttctattaaatgtctatacttttatctaaaataatcatctttaaataactgagatcatacaacattccctaagtgctcctgtgtagcacaatgttatgacctcttctcttgtcttcttctcttctccacctgtatagagatagtgacaaatcaagtcaatatctgtgaaacaaatgttctcatgattggtaaagcactcactggctgtgctgaaatctgggtatatttatttttcattatagctaaataaaataaaaaaccgaatagcaacaacaacaacaacaaactcacaaaaatctggaagataggaatgttcagtgtggcaggtaggatcaggaaagcagatgagtaagtgtgctcttgctgaccgatatttaccaagcactttccaggagccagatagtaggtacactccctgcattaactcatttaatactcacaccaaatctatgaaggagggtttactattgccaccactcccccagtttcttatagacaaagaaactgaggcatagagaggttaatcattttgcccacaatcattcaagtagtaaatggtagacctgacgttcatttcctgtgatcttgatcctctccataagatgaactcagtcttatagatgctttttcaaccacctcatcgtgattacagaacattctggctctattactttgaacaaattattcaacctctctgccaactcgggacaataagacatatatgacacatgatcttcaaatgtgtgaagattcagtgatgtaacaggtataaagtgttcagcacagaagcctggtgcaggccaggcactcactaaatattggttgtcttttagagtgattttcttctacctgaatactcctaagcaagggtattttcttctttattttatatcagtgatagttaacagagggcatctcacacaggaaacgatcaaaagaaaggaagaattagagggaaggcttgatttacataagtgttggaagctggcgtttctgaagaggccattgaaggcatactgtcatatctgagtctataatgaagaccagaattttagcaaataacttgagaaagtgtccaagcaagcagcaaaacttatccctagaaaaactcatatataaaaaggttggcagaaaatctgaaatgccatcaagcaggagataaagatttggtacatttccatggtccattttcaatctttttacctgtatcttctacctcaccagctcctagctcctgccgtgaaagtttgggcctgaaaggcaagaatgcaatgtgattgtattcacaccaaattgtaaatgttgggcttctgttctttccttagatttgttttgattttgtacttggattagggggtattgcaagatggcacctagtgtatgaaagctattaattgccaagtaggggcaaaagatcaaaaacgaaaaagaaaaattgtagtaaaaaatctctttagcaagagagcttagataaattacaactcccttagagctttcttttttttttctatttgtacagcattagtaatttttgctcaatcaaaagactatgctgaataaatggtgttcatgaaaatggattgataattgaaaatggattgataattaattgttggctgtcaacggtggctcatgcctgtaattccagcactttgggaggtcaaggcagacggatcgcttgagctcagtagtttaagaccagcctggccaacatggtgaaaccccttctctaccaaaaatactaaaaattagcaggatgtggtggtgcacacctgtagtcccagttacttgggaggctgaggtgggacgattccttgagctatagaggcagaggttgcagtgaaccgaggttgcgccactgcactctacctgacagagcgagaccctgtctcaaaaaaacaaaaaaattagctgggcatggtggtgtgtgctggtaatcccagctacctaggaggctgaggcaagagaatcgcttgaacccaggaggcagaggttgcagggagccgagatagtgtcactgcactccagcctcggtgacagagcaggactccatctcaaaaaaataaataaatacaaataaaaaataaataaataaaataaaaataaataaatggaattgttgcgattatcattatgattattatgtcatcttttagttgagccaatcctgaatgtatttaatgtattagtcctatgctttaaggcagggcttggcttgtgctgcctggacaccaaaggtctcagatgccatctcctgaaatgaccctacccaggacaccaggaaacagctgcatggccagtcctgacctctcaaaaagcaaccgtagcccataaatagcctgatgatggatgtgggaatgagctgggacctcattcccaggtcagattctatgtgaatatgggttctggtttccaactatgtcagggccagcagatatgagtttgtgtactacaagtcaacatttgggaggcctttgtagagctgactccacatccattttatcctctctggcgattgaaggcttgggggaaaacagaagaatggctaaatgagcagtgctaagtcttgtatgagtaagatggaacagttcaagaaagacaattctatgtgcttgagcatcatctctttgattctgacccattttttccactctcctgttttaacctgtcttctattaaaaaagaagtgaattaaactgttttgaaatatgagctctgctacttactaaccagctatatagccttgggcaagttacttgacttctcatttagttcatgggtaaagtagaggaggatcataatagaacctactcaggcttctaaggagaaacaagataacctagcaaagtcctcagcacagattaaataataaatattacctcttgtgaatttttcatttgtaaggaagcattttatcccctattttctctcattagcttgacaacagaactttaatccacatgagttgatgccctataatagaggagttgtgggttgatgttattttaaaattctaaccacatttcctcatcttttgatgacacttcaaacttttcattcattagcttggtattgtcaaggcttctaaaattgccagatgtcaggttttaatttgcagggaccccggagatcatctcatccaaccctctcagttttatagtgggaaattaatttaaaatttaaaaaaaaaatgactgacccatttgtttccagcattctgtaactgcattaaaaaataaataaataggccaggcacagtggctcacgtctgtaatcccagcactttgggaggccgaggcaggtggatcacgaggtcaggagatcgagaccatcctggctagcatggtgaaaccccgtctctactaaaaatatttaaaaaattagccgggcatggtggcgggcgcctgtaatctcagctactccagaggctgaggcaggagaatggcgtgaactggggaggcagagctttcagtgagctgagatctcgccactgcactccagcctgggtgacagagcgagagtccgtctcaaaacaaataaacaaaaaaacaataaatagcaataaaagagttcacgggaggtaagctgccccaggttctgtcccaggtcctttggttctgtccaaaatttatgccattggttatgtcactcttaactctctaggacctcattttttacactataaactgataaatttgacaatctctagctgaatgtatatgtgtgtgtctatttacctgtatatttacctgaattatggtaataaatatagatacagatttttgttataccacccattatcagcataatgcaatttccatactgtatttatggtccatggttaaaatgatgtgtatacacatgtgatgttttaatatattagagctcatttcaaagaaaggcagtgcaaggtctgttattagcaatgtgtggggtcttttaaagtcaacacctggtgaaaatcctcactgcccggagtacttttgaaactccttttctgagccctttgtggagcctgaggcacactgttctcatgctgcttattgaacagcagagctgatctttgcctttcaggaacgatttcagttttcaaaatagcctaaagtaaaataagcatagcaatcaatatgggcaaaactacatttagtcaaaggccagctgtgtctagcagataaaacgacatgatcttcttgtgtagatcttacactgaagctggcaggaaattagaaggcagtggctgctcctgtgtgaatagtgcctccaaaggtgccgtctttgaaggatgacattactttgggaacatgggtgcattctgctaaaactgtatgattattatcttatgatcgtatctctgtgtcaaagacaacagaatcatatacgtttgttgttttttttttttttttgagacggagtctcactctgtcgccgaggctggagtgcagtggcaccgtgtcggctcgctgcaacctccgtctcctgggttcaagcaattctcctgcctcagcctcccaagtaactgggattacaggtgtccaccaccacacccggctagtttttatatttttagtagagacagggtttcaccatgtggccaggctggtcttgaacttctgaccttagcctcccaaagtactgggattacaggtgggagccactgcgcccggcccatatatgtgatttttaccatttgtccatagtcgcaataggaaggatgagggagatttttggcctagcataattattctaaggaaattcagttctgaccacaagcaatggtgttgttagtgtgagaacctggtgctgtgactggggcattccctcagagacttctacttgtgccttctctctcctatgtaggagatctcaacccccgcgaaaagagtgcattgcatttttactttgaagaagtttgagaaagaattacttacaacattattattaagaacttagaagaatattcaaaacactcctataactaacgtaagattatagcaatcaatgtgctggaatacaaggacactctggtgttgggaacgactgcattaacaatcataaattaagtatacaatttgttttgtcccccagtgaattctatgaggagatatactttaaagccagtcctgttgaaaaccctgatgtcttatgaaaaaaagtagaaaattgaaagaacactgacctggatttcaaattcagtagctgctgcttttatttgaacaaatatttttgcctacggacccttttttccccctcctggtaaaatgaaggggtgggaccagaaaccttctttaagtgacagtccactgtggcccgcattacacataaggccttgctcctggccgcacttctgtcatttgctccattttgtctgacagaaacgggctaagatttcatttcataaaacaaaacaaaaagtgtttctacttctaaaaaggaaaaagttgaaaatctcttcccaagttcccttatgtccttgttttcctgtagagaaggtggtgctttcatctttcctaggccgagctgtaggttcaattttctataatttcagaaaagcagagctgggtttacctatggagcaagagaatcttggcaggaggaaaccatggagcagattccaggcttcttactcagcactgggaggcgaagaacttgtcacccttgagaccctctcctcttcagtctagctcatgtgttcagcgtgcaggtcatttgtgccaattagcttacctttccaatcagctggttgtgacctgtcattgttgccagctcccaaaattggaaggttttcttcctaaaatatcagtcctatgctttccagaaaggtatagaatgtgcagtgtcttcacagcctgtagaatgtgtaatccctcaagtgagattacagaagacagagatttcaaattcaatatgtctaaggtagaatagatttttttttttttttgctgtaacaggcatgaatttcgtgtttcaatgatacaacagtaatctagtttgccaagctaaagatttggacactattttattttcctcatctaaatgtcagatccaggaagaaaatgaatttttttctctttagtcctgtcctcaatacctagaaaggtatttggcacattactggaatgacatatttggtgagttaatgaataaattaatattcttctctttaggtcatattctacatccagtcttcaagaattgtctatgtagtttcaggtcttgtttgcaaacccttctatcctttcagtctgtgctgctgctcactgattgttctctttcttacctcttccttggattatcacaattttctcctaagtcacctactttcagctgcttctggccaataggctctccatactgcttcaagagtgctggatgaaacatagcatatgatcatgtttgtggcatcacaggtggtttatgttcttagagctgtcgatcaagaaaaataatgagacaagtctcaatcattttaggaagaggtttatttgccaaagttaaggacggatcctgggagatgggtctgtgcctttctctgaagatgattttgagggctccaaatttaaagaggaaagggcaggatattgagaagtagacaatttcatgtaagaggaaggcagggaaaaaatagtcatctgtgcctttgtctggctcagtgaatctacatttttttttttttacataagatgatatagacaaatgaggcagagtaaaaattcagggaatctgcattttacataagataacatagacaaaatggggcaggggaacaacgagatatgcctttgtgtctggtgggcagggggtgatagtacctgtaaagataagctatcaatttacattgctatggcaaaaatttaacagaaacaccttaaatgatcttgcagctcactaggaatttcctcatgggcaaaatttgggtggggtgggggcataggggggcatgtagctttcatcttgtagccatcttatttaggaaccaaaggtggaggcaggtttgtgtgacccagttcccagcttgacccttcccattggcttaatgagtttggggtcccaagatttaatttcctttcacagagtatattttccacattccctgtgatgtatgtatgtaaacaccatacacagaggaaagaaaagaggtttaagattaccgtgtttcactcctctatgaaattcttagtcacatcccgtgatccttaatttataatccaaactcaacagggcatgcaagtttcttcaggacccttctcgtttgcatctgacaacttttgagtctatattctggccatagtgactgtctcgtggccctcctcatgcatgacttgtggtccacacaactttcatccctttgcaaatgctgctctctggacacagagtctttcagacagatccactgctctttgaagactcagctcatatgtcaccactcttctcactgttgcctctgctcagcccccacggcacagaacatgctgtattgtagcaaaatcaggcctctttacctcacaaatagaaagtgaacatcttgaaagcaagggcaatatctagtttgtctttcaactcctgctttcagttgagtggcagctcaataaatatttgccgaatgagtgaaaaattcacccagcaaccacattatgcctcttgggaaaagtaactcctaaagagtgtctttataaataataaataccaggcttttccttgtgcagaaaaaacagacctcccaaacatgtttattttggtctaatacacagaagtgtatattggtgtgagaacaaaaacccaccaaatattgttataggaaacatatcttactgcaacccagctgcatgctctgtgactttaaaatacatgtttaaaatgctttgcaaaattgcagcatctgaaagagaagtacaggatagtggtgcacacagagctggccctgcagagctggctgctgtggggagtccccttggttacatcttcccatctgtacagacagcagcaggtggaacctgagctgttccatatgcggattagtcaatcgctttttctaaaggttccaagaggcaagcttacattttgtcttcagatctttatatgaaaataccactgtggataatgaggctgttgtatgcataatttaactttcggaagcctaaattccgccgaaaggcaaattggtacctagaggcatgcaatttgcatggggatttcaagccctcctcctatctattgtccctggcatggtgttgcttttcttctaaattattttcccttgttctttgaatgcctaattctgagattgtaaccagattaccatgggctccatatttaatagtggtttcagaaacctgctgagcctgctttgaccatttctgggagcataagttggggtttggcaaacctctgccagcacccagaggcagtctttctaatgaatctgctccttagcctgcagcccacctgcctggagagggttaggaccagctgagcctgcagctgcccagagtgggaggagctgatggagtcctgtgtggctgacttcacagctcaatctgtcaatccggttggggacagatggttagagaactgtctgtctgaattgcctcagaaagaatttggtttcttggctgcatcttcaagtcatggtccactttcctttctgctctggactggagaatgtggctgtgttgggaagggtactaactctacttttcaaagcctttcagagtaaggatgtgtgtaagtaaatcaagggctcaggagaactaactgctgattgtcttctgatatttcgtgtgtcatctaataggcaatgtcgattttgcatgcagtgcacaggagcatacctgtcaataaattctaactgctcagaaatgatttcttctgagtagcatgtttgtattttatgaaggtaagccatgaagacccaaagatgtgccaatatgtttactgtaaccatattggataattttgacatatggtgaccagggcagtttacagatgactgagaagttctttcctgatgcttagtaaatacctaagtcatttgaaatgccaactagaaaccaaagaggaaaagagaattggtgtggaagaggagaaaaagaaaagaagaaaagcgagacagagaaaagccattttacctaaaattggaggtctatttcagatcaatttttagatcaagagatctaaatctgggtcagaactcactgaatacttagctgggtgaaattgaccaagtcactccttcattccttaaaatgaaggcattggacttaataatttctggaggtctccttgaaatctaatattcagaaaatattttatttgtcctctaaattaggttattgtagctatttcaaagatgactggggtatgtacactagccagaaacagggtagcaggtctggggtagagacagaggtccaagttccctgtgatatggacaacacataaggaaatactgcgtagaagagagtggttccccagcaaagtccccaaccccaagcctagaaacctgtggccttaaatgggagctggtattcctgttttcacgcccaaatgttgccttttccaagaccaatctggcttaccatatctgctatactttgctcatataaaccccaagctccacgagcagaagagcacgagagctccatcacctttccagctcctcatccattctgctgggagtcacctccatccagcaataaaatcccccgcatttaccatccttcagtttatccatgtcacctgattctttctggatgccagacaaggacccaggtaccaagaggtcactgagctggttaacacttaagctgtctgcagatagcagagctaaaatagcactgtaacatgccccctggggcgtcagtggttgcaggcacccacccctagatgctaccttggggctggagcccaaaagcatttgccctggctcctgcctgtctgtgtgctccccctccagtaaagggtttgagcgcatggtggctgaacaggtaagccacacccctgtcacacatcctgtggcaggggtgggggtgggggtcagggaactctcctgtttcacctgcagccccccaaataattatcattctttgagttcttacaatgtaccaaaacctgcgttgagcaccttaaatacattaccttgattattccttaaaaccacctgcgacgtgattattgtttcccttcttgtatgtctgagaagataatgacttaaactgcctcaaatcccttcatccagaaatgggatgtcctgcattttgaatctctgctttattctacctctataaatgtctaatttgcctaatagtgatcccctggttttgggttttgacaagataggggcccacctaccatttcctcggctattctatagttgtatgttataaggagaccttaaaataaagatatgatttgtcttgctaggagcaaagcatgtatgcatagctcatataagaacacatttctatggagataacattttgaaccaaagtggctttaaaaggcagcagagatgtgtatatttcctgaaggcatagaacctttttctccctctagttaacatggcccttcttttcttaagactgacagttgtattcttgttgggcagtcactagaatttgttctgttgccagacctcctggggcatcaaagtgctgtctgaattagagaataatggcatgatgaggtcaatgacagctctgaaaatgacatgttgccatagtggtaagaaaatttcaaaaatataaagaactccattatcttatgatattttattagtatctattctcctggcatagtacagtttttattcttctaggaatgggttgaataagttgagtccactcttatttttatgatctaatgcatagaggcaacatcaaaatacgaatgccttgcaaaagattgcctatgttgtgaaaatgagaagatgtagttgttaaatgcccataataagtcaggcattgtaataatttataagagtggataaaaatactagaattaaaatttaggggtttttaaaaattcctttttcttcacatctgaagtgtgatattgatctggatgtgtggttgactccaggatggtgaagaatatgtaagtagggattgtgataaataaagttcaaataatatgagattaaaaaaatctttatagaaaaggatcagggagatttgaatacaagagttatattgtttagttagttctagctttccaaagattttcagtagattttattaaaaggattatgttccatattagctttttttttttaaaattttgctttgcagacatttaaagtgatcctgatattcaatggcacatataaccttcattgatttgctttccagctctttgtgactttacaaattcaatgcatacaggtaaagtgtaatcaagttattaatctttgagaatctttatgtactacttataacagaatcagttcttgtgactcagtaaggaaggcaaacattttcatgaattgcagtctgtagaggagaagagtagtgttgattgtatttctttacttttatatcacagagttatattacacccagtcatttacatttgatgctatttgatatgataacatttgctatgtgaacagaattgtagaaatcaaaaatcatttaaaaagagtctcttcctcccagtcctagaataaaacagttccgtctggcgtactgttattcagagccttctgatgaatactatgttactaacgggtaagaataaggagaagaaaaaggaaaaaggagaaaaggtaccatttctgcataattgaaataaaataggaattactgtgggaagtatttcctggatgttccacaagaatttattttactttcagtctctaaattatgacagtgttgcttataacctttaacagttggattccagatgtcctccatttaacactgttcatccaaacatgtgtacacaattggcatatctactttttatcatgctgtgataaacatcatgtatttcaggtactgattcttttttatacatcaaaactgcttcagatcagcagaactcagacacagtgtatgctgggacctcaatagtgtcagccagggtggggcttagtcatggttcaaagaaaaataaattgaaataatcgtatgtttttcttaaaatatgttaatattgcatgtaaaatcttcacatacgtgggataaacctcacttggccatgacatattatcctttttttttttttttggattaagttcactaaaattgtgttaagattttttgcatctatgtttatgaagaacacttgtatgtaatattcttgtagtgtctttggttttggtgttggaggaatgttggcctaataaaataatttgggactgttccctcctcttaaatattctgaaagagttttacagaattggtgtttttttaaattacatttatggtagagttgccgagtaaagtcatctgggattggagttatctctgtgggaagattttcaactacagtttactgatatagatagttcaataattatatataggaaaattccagttatctatttttgaaaaaccttctatggtttgatgttttaagtattatttattatttatttatttatgagacggagtttcactctggttgcccaggctggagtgcaatggtgcgatctcggctcactgcaacctccacctcgcaggttcaagctattctctcgccttagcctcctgagtagcttggattacaggcgcctgtgaccacacccagctaatttttgtattttttgtagagacggggtttcaccatgttggccaggctggtgtctaactcctgacctcaggtgatacacctgcctcggcttcccagggtgctgggattacaggcgtgagccaccgtgcctggccaagtaatttttctgtttcatcaaagtgtttgttggtggtgacataaatttgttccatataatttcttatttttaaaaatacctctacagtctgtagtgctgtcatttctctcatttctgttatcgataatttgtgtctacttttttccctaccctcgtcactcttgatagaatcaattttattaatgttctcaaaggatcaagtttttatttcactagtttttctctattgattttcatttttccattttaaaaaatttctgacttcattattacttttttccttctgcttattttgtgtttcatttgattttccttgtttttcttttttaatatggaaaataagattattaacatgaggtgtttttaaaattctaatataggttaccagtgctataaatttcccaccaaagtcttacttttgctaattcctacaaatattgatatgctctgtttttattttcagtttaatatactttctaattacttttatattattcctttctccattggttaattagaagtatgttagttccaaatattttgacatttccctgatatcatttacttattgatctctaacttaattccactgtgttcagagcacatgcattgtatgagttgaatcattttaaatatattgaaacttgtttaatgaacccgaatatgatctatcctagtaaatgtggcatgcacactagaaaagaatatttatctgctgttgttggatggagtgtactataactgaattttttcaagttggttgacttttgttcaagttttctatatctccactgatttgctatcttcttgactgtcaactaccaagagataagggttaaaatagcagattataatggtggatttgtccatttctcccttgcagttctattgatttttgcttcatatattttgaagttctgtagtaagctgcatagatatttatcattgttatgcatccttggagtgtttacccatccctttatcattatgtagtatcattactcttttgttttctttcttccttttttttttggagacaggttttcacaccgttgcccaggctggagtgcagtggtgagatcatggttcactgcagcctcaatctcctgggctcaagagattctgccatgtcagcctcctgagtagctgagactgcaggcatgtgctactgtgcctggctaatttttttgtttgtttgtttttagtagagacaaggactcgctgtgttgcccaggctggtagtatttctctttattcctcaaattttggtgattataaagtctacttggtctgatgatagtgtaattactccagctttcttttgggtattgtttgtgtggtatatctgttttcatttatgcttttagcctgtttatatattttaaagtgggctttttgtaggcagcatataattgggtcttgctttttgatccaatatgataacgtttcctttttttttgcatttcctttgttgttttcttacctctatttctttgttttattattttcgtggttgctttatcattatttgatagttttagtatatacctctagctttcactgtcaagttgcaagtaatattacatcacttcatgtgtattataagaactctgcatagtacacttcacttctctctcccctcctcatctttatgctactgttatcaaacattgtatatacatatacataaacatatacatatataaataaacctcacaatactttgttactatttttgctataaacagttgattatatttggaatatttaaatgaaaagatactttatatttactcacataattgccatttcccatgctctgtatttctttgggtagatacatatttctggctgttaattttcttctgactgaaggatgtcctttacatttttttgtaatgcaactctgttactgctggattttctcagctgttgtagccctataaatggctttatttcacctctgtttttgaaagatacttttgttgagtaaagcattgtagattaacttttttgtttttgttcttccctttcagtttcttaaagatcagctctattgacatctctgttgcaaatgtttataagaattctactgttatcattacctttgttttctgtataatgcagctttttctgttggtcacttataagatttacaatttatcactggttttcaatttattgctgtaaaaagtttattatgatgtgcctttatatggttttcttcatccttcttatgcttggaatttgtcgagcttctcaactctatgggtttataattttcatgattttttttaattgactattatatttgaaaatagctttttgttctcatcttcttctggaactctacttctacatatgttatatgcctaatatatactttgaagtcgccccatacttcactgatgctcattattgtttttaacttcctatttttgatagtttctattgctatgtacccaagacccctaccatttcttctgcaatgtctaatgtgtcttccatcccatccagtgcatttgttatttcagactatatagttttcatctctcatttgttttccatttctcaagaatcactgtccttctttgccagaaatctaaagtcttagtccatgatactacattttggccaggactggaaatttctcatcacctttaatgtatgtaatctttgccaaatgaattaaattctctctcaattttcttttaaaaaattgtaattacaaattagctatgtcaaaaaaagattgtttaaaaaataaggtgatccagaaagacagcttagtatattctttgaagcatcttaattagtaaaggctagtatcattaaaattaggaagtgatgcttggagtcattttaggcattgatactttattctatgtgatcagttcattggaagaatgaccctgggctgagggaatgcatataggccatgtagtatgagaaacaaacaagaacaagaaccaaggagagtatttgattatttggatcctagaatcttagactctcatctcagaagcaagattaggataagaacaggacatgggactagatgcccagtccatggcctgagcatcagtggtaaaacaggagaaaactacaaggaccaggtggatgctgtcagcttgccactgtactactggacatggtaccagatttttctgtgtgaaaacctggctcagcagtagatggggctgagctttcagtgtggagataactgtgtctacaatcaagagagtctgagaaagacagggattaaaaatattatttcttgctttatctatctatcttattcatttacatgaatgtccttcactattgtaatgatcttaaaaacaatgaaaccccaaagagtttacttcagcggaggcagagatgtgaataaattatggaagcttagggaccctcatatcccccatctcaaaaaaatgatactgcagctatgactgcaaaccaaatgcgattgcctttctttgtgttcacatgatgcctgaaatttactagatatgtttcttctctcatgcagcctaacatatatgacttgtaaaccagcccatgatatgtcttagttaggtaaggctgccataccatagactgagtggcttaaacaacagaaatttctcacagttcctgaagctgaaagtccgagatcaaggtttggcaggtgtggtttctccagtggtctttttccttggcttgtagtcagctgcttctctctgagtcctctcatagcaattctctatccacataccctcccgtgtctcttcctcttaaaaacaccagacctatcatataagggacctcttcttaggatctcattaactttcattacctccttaaaggtcctgtctccaaaaacagtcacattgcggggttagggcttcaacttgtgaattttggcaagggttgtgggggggcacaatttcataacatagtatgaggaataggtgtttacacagaatttgtctcctgaacaaaacttctatatccttatattgcagaagccaacactctggctcagaggtttatggaaagaacatttgctagaaggagaagggccagtatcttcactggtattttggacaagggtcttgtttggatatttgttatgtgtgtgtcttcaaagtgtgagaccttcggccacatccctcagtggctgaagtagcattctggattaaggaatttttaaaattaaattaaagttttaaattaacacatgataatagtacatatttacagggtacataatgatgtttcgatactatgcaatgtgtagtgatcagaccaggataattagcatagccatcataattcatattttttactgattggttggccaacatctctccaattcatgaatctagaggaacgtggtttatggacctctgctcctgtggactctgttcaagtccgtaaatggtttgagcaaggattgctcaatttctgttaacctcaccatagtcagggtttggggacctgtaactgccttggagtgatttcaagatgctgggccatttccagtcatctcttattctcacagaaacctcctggcatgcctggcacatcttcactcaataaaaccatttaaataaatgattgagcaaagaacacctattcaagtgtccatgccagaggggaagatgtaggagcatactagaagttaatgagccaggaatttaaagttttaatgtgtttgtccctgaagtttgcctcatccatgcttatttttagaaagccatagattctgttgctggcactcatttctagtgctttttttattgctgatcagttttaaaaagtaaaagcaagttcatgccaactatatatttcagccattttctgcatcctttgcctgcctccaaagcagaggtatacaggggagtggagaataaagccactggacagccgagggccatgtagtcccagagacagctcttccaggagcatggaagaaaatattaactctttccacttgtactgagatatttttagagtggcttcttttctctttggcttgtgccagggtgctactttattgaggagctgtcaaactttttaaaaaagaattatttctatacaagaagagtttccttgattctatatccattgtgctcttttataaaaatctcacttgttctgggaacttactaattaatagttacattgcaagtttttttttcttttgcctcaattacctaaaataagggtaaatgagtgctaagtttttttgttttgttgtttgtttggtgggtttttccttcttggtttttttttttttttttttaaagaaaaaaaagaattactggaaattacatttcaggggcacatgcctagtttgggacagattgaaataagaagacatccaaaacaggggttatagagcacacaacatgtatttccaagtaaaaaagcaaggctgtttttagatcttttgtcatattgagtcattgtaaagaatgagactaaatttattggccacataggataatctgtcttattccttcaaagaaactgctcaggtacatgacatttctgtctccaaaccaaatgtctaatgtgcttttatcttggcaatgtcacttaaatccccttccaaatcttttcttatatgtcatcatgtaaaatagactcctggaaaccaaaatggctactcaggaaggccacgctctaggcagttcatcacaggaagctggagctctgtgcttctggtcctatgctccctgagctgctatagctatggaccatggctaccacccaagggtttcccccaaaccatacctagcctctgcggtctgcctgaggtaggaatttcttagtgtgcattgattctctttcttccactttcctgatgacatttcattacagcaaagaaaatttttggccataaagattttccatatatggatcttttccaaaatctgtgtctgtagttaggaacaacttaataagaaggctcagtgttggcaccatttttaagaatatttatttccctgggctaatattcttttaaaaatactgcttcttaagggaaatgatacctgtaaaagaaaaattagaagcttctgaataaatttgaagaggaaagtcatgaaaaattataattatataaactttacactattattgctcttttgctatattttccggtcatttttgctatatttacctgatttttatagtcatgattacataatatgtttttctctctatttgtttaacattgtattataatcaggtttataatcaggttaacagatgcttcataaacatcacctttgacaactgcatgaaattccactgtatgactccaaatgtaatttactgaactgttctattaatggaaatttatgcaattttaatatttctattcatatagatatatggcaatacagatatttgaacaacattttttttctgatttaggatgttttctttagacagattccatgtggaaatatgaggtcaaaaattagaaatatttttaaacctttgataaatagcgttttccatactgtttcctacctcgttgtaagtacaagtttgtccacctggcttcctaagttggtcaacataaatttgcaccaacttaacatctgaaatataataatatacactgaggttcttagcataatttgtgtttcttttaaattggcattgctgatgacattaaccagtgtgactggggaatgattctgttgtccactgatccatttaatgtctcagttctggccatctagtggtctagtctgtgttttctactgaacaacatattgagcttttctctgctgcttcctggctttcatatttactgcagagaaatctcattgtctgcaatgattggacttttagaatagaatcttagtcatctgtattctacggcatgaaaactaggcccacactatttactactgacctgaggactcagctctgcctgcatgtagacctggaaaaacaccttctgcctgtgctcagaatacctgctggacctggtcactctctacccatgctcttttcctcaatgctttccttcctttcacctgttgtcttttcatcttctctctttttattcttggtctggcactcgtgcaagtagaagtgatttgatagcttcctcaggcttttcataaaaagggaccatttccatgcaagtgctatttttaccagtctcagaattgtgtaaaaggctttggttctgtgatattttctggaccacactataaaaattccctgatgctatagacccatgggttttactttaactcagtatttcctaaactgtgcttctgtggaatttcagttcaatttcaatgggagccaggaactaaggttcccatggtcaaataaactgcaaactgtgcttcctaaatggtcttcttgaagatttgcagttcatgttatcatatctaatggtttggagacatcagaaggaaaaaaaaattatgttttaacttggtcactccccactgaggaactattttttttctctttttattttttatggctatacctagagtcatttttccttaaaacccatctggaaaaagctggtttgaccatgcaacctgtttattaaagtggaccatggttttacatcaaggggaagatgtgacaaaaaataaacattttccagttttggagctggactgtgcacacatttctgttcagcagtattagaaccccttcaacatttggaaattataatgtttctgcagatgggaacaagctggatgccaaggagtgtgcatgagcgagagcagaggcccagcctgtgagctccactctgctctgctggcagtgatccagtgactacctaacagagagaagtggatagctttatgggcaattgtttgcccactggttgaaatgcttgggttggatttatcggaaccatggtcacataaagttgtctgtcacccaaagggaatcataaagatgccttgagtaccagagaaggatcattgatttctttggagccatagtgttcagcctctcacagctggggaactgctttgctgtgaaatagaatttcagttggatacaaaattaatcagttttcacagttcaaaattttgactaagacactgtgtcagtgtgtttggtacatgctgtgtttgagcctggaagcctacgcctcacatttgtgtagcatcgtgacaccaccaactgcctgttgatgtcatggggaaccagggtaatggggagcggacagtttctcctctgccactctagctctttctcccagcttgaatacagggctgacctttcacaaactaacacatctagaagggaccttagtgactattaatccaacactgaccaggggaagaaatccttttgcaacacccatgatcagccgctgacccaacctgtgcttgcatacttgtaataatgggggatccaccaccctacatggcagccctatggttagattttgaatgataactaggctttggtgaaattcctgtttcgtgaataaatcaaaaagaaggcaaattccatgttgtctcatctctctactggcatgagatcaatatcaaggagacaatcaatcacttatctttcatgtctctgatgtgatccatttgctatattttggtctcaaatgcttgggaagacagtagatagagaaagaaactgatacttatgatccaaaatgatctgccaaatccaatctcttgaggcaattaaattagaaggatatataggtcttcccaagaaacagaactaggcaaacataggcatttatatttggtgcaatatcctcaccctaacaaaaaaagaatgtttttctacttatatagctgatcacacagaaaggatcaacaatcgagtttttgaacataatttttcatttctcaaaaccctacttgcataaggaaaacagtctgttcacaaagagggtttcagttttgcagtgaagtgtaatgggaagaatatattcagatatgtttattaatcaagatctacccctgtctttttattctatattcgtttaggtggtccgtaacaatggggaagaaaagatgagcaagttatggcccttgtccttaaggagctcaggatctccccagtgggctgcaggaatggcaaatacccacaaaatagccgccacacaaggcagagagtgatacgtgttctactaagaatagcagtaaaatgctgaggaatcagagagatcaaggttaatgccaggtggaagactggggaaaagtacacagctgaattgactctgagttgcatgtgggaaaatggatgagatttcaaaaggcagagattaaagagttactgctacatggaggcattttcctagaatgtccctcagtataggaggcaggggctttcaaaactctgtattcatcattttctatagacatttttccttgtagtatgtcttgtcactgtatccatagctaaagttttggagatttgtatgcttatatcattgatgggattgttttaaataaatgtcttataatttagcaattttagttcctggagtcttttcacacttactgagaaatctacaaggtactcttcttggttcataggtaggtacccattgcattgacttttaattttgggtggagtctgagtgtccttattctcttttctcatggaaaaatgtcgtgccctggccagggaggaggaaaagaaaaacagcatactgctggatggctccaatctttctgtagtattgaagacagtgggagaaggaaagagagaaaaagggatgggagccgggggcggtgactcacgcctgtaatcccagcactttgggaggctgaggcgggcggatcacgaggtcaggagatggagaccacggtgaaaccccgtctctactaaaataattagctgggcctggtggcgggcgcctgtagtcccagctactcaggaggctgaggcaggagaatggcgtgaacccggaaggcggagcttgcagtgagcccagatggcatggcgtctcaaaaaaaaaaaaaaaaaaagaaaagaaaaagggatgggcctttcaatctggtgagtgcaagcaagagtcttgccatggtcagggatgtgtaaataagggcagctttctctcaatatggacattctcaatggacatttacattcattcattacgttttcctcgaagcatggaaggagtacatgctgtgtatcaggagttgccttttcaaagctcacagtctggtgaagggaaaggaaacatgtaaactggcatttgcaatgcaatatgataagggctatgacaaaaggaatgtggaattctgtgtctttgagggcagataagagagactgcaaataatagctctagaagacaatgtctgagccaagcaagaattaggtgagcaaaaagatgggcacctttttaaaaattatgggcatttagtgagtgattttataaagaaaatagcacattcattcatcttaattaagtttactttgcagttaattacgctgagtgaccttggggatatataagtatttgatacagacttaatatgaggtggatgcaaatatcactgataggtgagtgtgtgctgcaaaacgatacagagtccatctgtgtttgagtaatgataattatcaaatctcattggaagtttttcagttattgaatggaataatatgcagttcttctcttaataaaattaattcaagcatactttatattaaacaatatattttggaagaacactaccaacaaatttaccaaaacaaaaaaaataatgtcacagctctcaggaggtgccagcatttattgattacacactacatgttgttacatacattcatttatataattctcattttaaaaaatcttagctgatattgttggctactgcttacatttcatcctccgtggcctttacttcaactgaatttcagttttatgccaacaatcagcccactgtccttcacatggccgtgcatttgcttcatgaagctactcaggggaatgccaatattcagactgagaatgcttaagaggtgggcatgggactcaaatcttgttaatgaattaggagtgatgatgtttagatgtgatgcctaaaatcatggcagctatctgtgacaagggagcctagcctaaggatataaccaatgatggctcagcaggatatagccaatgatggctcagcagaatgagtcctttattttgggggatctaggtaagcaactatattagacaacctaggaaccctttcctactaaacgaggtaatgttattttccttcagatttaagccatttgtgttgagttttctgaactctcagccaaaatcattctcattgacaggtaggtactctcattatctccattttacaaatagggaaattgggggttcaataagttaagtcagcacttttggaggctatggcaggggatcacttgagcccagaagtttaaggcagcattgagccatgatcatcatgccactgtacttcatcctgggcaacaaagcaagaccctgcttctcaaacacaaagaaaaacaaacaaaaaaaagaagttaagaacttaatgaacatcatgcagctggtaaaaatatcagaattaggatcaaaatcaagtctgtcttacatcaataccctagtggttaatttgtggttagacatcttctacatatattttttgaaacatatcacactaaagcactgaaataaataatgacaaaaatgtctagtaattcaaatatataatctgtgagaaagccactttccccagtaatgttttatatcaagtgttggtaaattgtgtaaggggtcaaataataaatattttagagtttatgggtcagatggtttctttcacaactactcaactcattgcagctcaaaaagccatagacaatgcataaacagatgagctcagcactgtttcagcaaaattgtaattacaaaaacatgtggcagaccagatttgggcctgggaccatagtatactgaacacttctctacatgaactaaatctgattctttgtgaagggttcgccagggaggatgggcaaaagctcattttactaggtgtgtaccaaaaaaaaaagtcacaccagtagaagagaaaaggagatatggagtgcagtgtggaagggacagagagtgcaccctcttcacaaactttaagatatcaaagaaaatgactgttttcctactttgtagtgcagattgggaaacagcttcagacaacacaaaaggaggggagctcatggcttccaccatcagagaggcaaagttagatagtagatttctagcctactatctgtgcttaaattggaatttctgttaaaaattccgaattttctcagcaataactttcaaagaccaccacaccattatctttctttctttcttttcttttcttttttttttttttttacagtcttgttctgttgcccaggctggaatgcagtggtgcagtcttgggtcactgcaacttctgcctccctggttcaagcgattctcctgcctcagcctcccaagtagctgggattacaggtgcccaccaccacatctggctaatttttgtatctttactggagatggggttttgccatgttggccaggctaaagacaaccgttatctttcatactcaaaatattgaatgacccacaagcagtataatacatagctgttatttctgcaaatggagagataagaattggaagtgaacagatggttatagctctttgatttttgttttaattgctttccaacaatcacagagaatggaccaattttctcaataatatttgttctgaaacaaaggtctgggagtcaagtttgtcaataaggcaaagagtttttgggaggtatgtgagggtttttctttttttttctcaaatggtttgcaaaggcataacatgaaattgactgttatttatttgcagaatcttaactactgagccatatttgtccccttttacttcttactaaactggaaacataaaaaagggtttataggaaaccaaggttaacagataggaacataaagtttcactcttctttcctgcttctggcaaccactaatttattttctgtctctgtggatttgcctattctggacatttcctataaatggaattatgtaatatgcagacttatgcctactgtctttcactgagcataatgctttcaaggttcacccatgctgtagcatgcatcagtaaataatgtcttttattagtgaataatattccattggatagatgtaccaacttttttgtttattcatcacttggtggacaatggagttgcttccactttttggctactatgtgtaatatttctataaacactcataaacaagtatgaacatttgctttcaattctcttatgtgaggagtggaattgcttggtcatatggtaactctaacatcttgaggaatgatcaaacttttctgcagaagctgcaccattttactttccccagcattgtatgactattcctatttctccacattcctgccaatactcattgttgtccgttctaatgggtgtgaagtgatatttcattgtagttttgattttactttacataaacactaacaattttggacatctttttatgtgtttgttggatgtatgtatatattctttggaaaaatatctattcaaatagaaaggaaaattttaaagaagagaagatgtatgataaaatttatattgactgcatgtctataatgcattggggtctttactcataaaaatgaataataagtaatattttaatcatattacataaataagattcagataaattaagaacttgctaaagaaaatagttggctatggttaagccaagagtcaaataagatccgcacgccttccctttgtcccatgtacatatgcttcatgtgcatcgatatgaagatgtacatcttacagagatgaataagacaaacatgactgaataaagcatgagtgtgcccctctcctctctggaaaaaagtaaaaacataaaaaacttttatggaataatgcagaaaaggatcaattctctttctgatgtcaatatgatagtaaagttgtaggtagtgcacttgtgagatcatcaccttactagtgattgatgggggcatcccactctttattgatctagtctatgtaatagcacatgagaaatccatgaaccgccctgtggagggcttatttatcttttaaaatgctataaccacatccagtatctctaaacaagtgcttagaagttagaaaacattatgagtatattagccacctagacaccactctcccctgcccagcacttagcagagtgtagattgggtacatgacagtcacgcatgccttgttgctcctgggaggcagacttgccttattatctgaactgatttcctcactttccaccccaggaatcaatacagtactcagcagtcttatattagatgctccatgatagattgttaaataaatgactttaattggcatcatacagcgatattacagaattagatatacagttgatgctcaataaatatgtgctgacttatttagtaaagaaaggaaagatgtgcttggtgccaagcactgtgaaaatcccactaccacacattgtcttcttttctcatttaggcttcgtgaaaccccatgaattatatgctttcatatattcaccttattcatgttcaaaatgccagcaagtagtaaagtagtaatgcaaacccagatctgcaaaagtacattacaaagcattaagttggatatttagaactcggcacactaaatttcatctggggctaaaacacagagtcccaatgtagtaccaagaaacaagcctttcccacttttgcttaagatgacaccaacactgccatgaagaagatgaacaggggtgcacaggatgatacttcttcaaataagtgaaatgattgatgtattgggtactttatgcaagaagatttggagaacaatgtaattgttttataatctgattgcgtatccctaagacctggatgttttcaaaatgataaatgacttaatgactgaatacattctagttgcctgttttaaacaaatgtgacattttaggggttaatgctacattcttgatttcctgtatttttagtcagtaactgtattagtctgttctcacacagttatgaagaaatacctgagactgggtaatttaagaagaaaagaggtttaattgactcatagttccacatagctggggagtcctcaggaaacttacaatcacggcggaaggcacctcttcacagggcagcaggggagagaatgagggccagcagaagaaacgccagaggcttataaaaccatcagatcttgtgagaactcactcactatcacgagaacagcatgggggaggctgcctccatgatttggttacctcccaccaggtcctttccacacacggagattatggggattacgattcaagatgagatttgggtggggatacagccaaaccacttcagtaactttctctctgtttaaaaatttttaaatttctattttttttaaagtttgaacatgttgaggttcaaatgtcttaagcttccaagtgctcttttgacttttaatatatttctggagtccctttttgtcttcttggtccttaacactttggttgcatgcctgcatttcctctcctgcttgtgtgcacttctcatctgccatgtctaggaagttgtatcctttccacttgatttagcatttctttatcttctgtcgtgcagctatcaatatgccatctagggtgggggctggagatataagacagcttaaagatatcatccttttacttaaacaactatccatcttttaaagtactttaatataattttcataacttttccggtcagccagagtgaatactctcgaaagtgtctttgacagttggctttattttttgaggaggaaacttctcttgattgactttgtttgcaccgtgatttgcagacaagatactaagaatatgggggtggtggttggggctagtgttagagttagtcctgttataatctcagtttctcaacccatccaaatgagaacaccatagaagtaaaaacatatttcctatgcaaaggctgcattaagatatgtctagttcccacctcaacccactctctaagtctttcttgcataaaatgcggagccaccacaccactactgacaaaagtgccctctccacgaactctcctagaatattttttctacttctgccatgacacttgacatagttagccaatgcataagcagggcttcaagccaggctcttgtgttgcaatatctatcctttctttataccccaggtggagaagaaagtgcttggatatctgaacactagaataaatgattcaaataagagctaaaactattaaggggaaaaataagatttttaagtaattaaagtgagtgatattcattttcatgaaggaatctgaagaatcaagtcaatgtttagacattaattcaaagccatgatggaatgaaaagaaaatgtgacagagaaagtaatagaaattccctgagtcaagcactgtctttatttttgcactcacctacctccccccaatatctactttgcacagtattttagtgtgtgctcaaaaaaatgggtgttgggtgcttgctttggcagcacatatactaaaatgggaacaatacagagaaagttgtcatggccgtgcacaaggatgacatgcaaatttgtgaaacgttccctatttttatggttaatgggtacaaaaaaaaattagaaaatgtaagacctattttttgatagcacaacagggtgactatagtcaataataattgtacactttaaataactaagagtgtaataggattgtttgtaacacaaagtataaatgcttgaggagatggataccccattttccatgttgtgattattatgcattgcatacctgtatcaaagcatctcatgtaccccatgaatatatacaccagctatgtatgcccaaaatttaaaaataaaaaatatttttaacattggtgttgggtagatgggttccaagatgaatgaactactaaaaaacgatgccttctaattgctcttatttacttattctggagtgataaatagagtgtttggcaaggagaagcttgcatatgtgtagcttaaaagagtccaaaactcagcacggttggaaatgcagaatattaaagagatttctttatggagttgggcttttttgacttttccttgcctttctatggatgaggtgtgaaataataagactgttgtgtggtccctccatagttcagtttcatttctgtaaaatgaaaatgatatttatattggattaataggtttattccaagcattattactgcatgctgacttctaaagtttctcttatcccaaggttgttggtttgaattgttaaaactataagtcctaagaacagatttatttattttatatgtatatatctgttttatttttatagatttagggagtacaagtacagatttcttacattaatattttacatagcgttagagtctgggcttttagtgtactcatcacccaaaaagtgatttggtaacccaataggtagtttttcaaccctttccttcctcccaccttcccatcttttgtagtctccagtgtatattatttaccactaaatgtccatgtgtaccctttgtttagctcctggttataagtgagaatataaagtattttactctgtttctgagtttactctgtttctgagttattttacttaggatcgttgcctccagttcctgttctattgatctgtatctatttttataccagcaccatggtgttttggttactaagccttgagagtcctagatttcataaaatggtatgatttcttttttatggctgagtagtactttatggtatttatggtatatggtatttctggtgtgtgtatgtatatatatcatactatatgatatatatatatggaatatggtatttatgttatatatatgcacacacacacactcattaatcatccattaatgaatacttaaggtgattctatatctttgctattgtgaatagtgctgccaaaaatatgcaagtacagatatctttttgatataataatgatttctttcccattgggtatatactcagaagtgggattactggatcaaatggtagttctatttttagttcttggataaatctccatactgttttccataaaggttgtagcaatttacactgccatcaacaacgtattagcattcccttttctccacatcctcacaatatctgttgttttttgactttttaatattaaccattctggctggtgtaagatggtatctcactgtggttttaatttgcatttatctgatgattaatgatgttgagaatgtttttaatatgtttattggttgcttgtatgttttcttttaaaaagtgtgtgtttatgtgttttgccccctttttaatagagttatttatttttcttgttgagctgtttgagttccttgtagattccggatattagccctttgtcagatgcatagattgcaaatattttcccattctgtaggctgtctgtttactgtatttatcatttattttgctttgtagaagctttttagtttaattaactctcacttatatatttttgtttttatgatgtttgtttttgaggacttggtcataaattctttgcctaggccagtgttcagtaaagtttttcctaggttttcttcaaggatttttacagtttcaagttttacatttcagtctttaatttcatcttgagttaatttttgtatatggtaagagatatgggtatggtttcatccgtctgcatatggttatccaatttttccagaaccatttattgaatagagtgtcctctccccagtgtatatttttgttgacttagtcaaaggtcagttcatcataggtatgtggctttatcaaatctagggctctcaatgctgtagtaaccaaaacagtatggtactggaataaaaaaatagacatatagataaatggtacagaatggagaactgataaatgatttcagtaaagtttcaggatacaaaatcaacaaggaaaaatctgtggccttgctaaacaccaataataataatcaagctgagaaccaaaacaagaactcaatcctatttacaatcgttacaaaaaaatacataggcatacatttaatgaaggaagtgaaagatctctacaagcaaaactacaaaacactaatcatagatgacacaaacaaatggaaaatcaccccatgctcatggatttgaagaatcaatatcattaaaatgactgtactgcccaaagcaatgtacatattcaacaccatttgattacattaccaatgtcatttttcacaggattagaaaaaaaatcctaaaattcatgtggaaccaaaaaagggctttaatagccaaagcaatcctaaacaaccagaacaaagctggaggcatcgcatatctgtcttcacattatactaaagacagatttataccatgagagtagacctgatgtacagcagtgcacttcactaattgtattgactgttaagaaattacaataattttattctatatggtaactaaccactgctcaaatcccccctgaaaattgtccccccaatgccaccctggatgcctgggttcccaaatctcctcagtgttaatccagaaacaagagttaacatttagccccagagggacctccaggacgctgcttctctcttatgaccgtacagatttattctgattagtcctgtaatttccatatgacttattaaatattttgaacatcacatccatacatactttccagacaagaaatttggatgtgggagaacattctttaataaagaaacacataaattctcatttaaaaaaactgctttttttttctttcttttttttttattatactttaagttttagggtacatgtgcacattgtgcaggttagttacatacgtatacatgtgccatgctggtgtgctgcacccactaactcgtcatgtagcattaggtatatctcccaatgctatccctccccgctccccacaccccacaacagtccccagagtatgatattccccttcctgtgtccacgtgatctcattgttcaattcccacctatgagtgagaatatgcggtgtttggttttttgttcttgcgatagtttactgagaatgatgatttccactttcatccatgtccctacaaaggacatgaactcatcattttttacggctacatagtattccatggtgtatatgtgccacattttcttaatccagtgtatcattgttggacatttgggttggttccaagtctttgctattgtgaataatgccgcaataaacatacgtatgcatgtgtctttatagcagcatgatttgtagtcctttgggtatatacccagtaatgggatggctaggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttcatgtgttttttggctgcataaatgtcttcttttgagaagtgtccgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtaatgcctaggttttcttctagggtttttatggttttaggtctaacgtttaagtctttaatccatcttgaattcatttttgtataaggtgtaaggaagggatccagtttcagctttctacatatggctagctagttttccaaacaccatttattaaatagggaatcctttctccattgcttgtttttgtcaggtttgtcaaagatcagatagttgtagatatgtgacattatttctgagggctctgttctgttccattgatctatatctctgttttggtaccagtaccatgctgttttggttactatagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttctttgtatcctcttttatttccttgagcagtggtttgtagttatccttgaagaggtccttcacatcccttgtaagttggattcctaggtattttattctctttgaagcaattgtgaatgggagttcactcatgatttggctctctgtttatctgttgttggtgtataagaatgcttgtgatttttgtacattgattttgtatcctgagactttgctgaagttgcttatcagcttaagcagattttgggctgagacaatgcggttttctagatatacaatcatgtcatctgcaaacagggacaatttgatttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatatctaatttattgagagtttttagcatgaagggttgttgaattttgtcaaaggctttttctgcatctattgagataatcatgtggtttttgtctttggctctgtttatatgctcgattatatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgagtctctgcccagctttggtatcagaatgatgctggcctcataaaacgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaatttcttcctggtttagtcttgggagagtgtatgtgtcaaggaatttatccatttcttctagattttctagtttatttgtgtagaggtgtttgtagtattctgtgatggtagtttgtatttctgtgggatcggtggtgatatcccctttatcattttttattgcgtctatttgattcttctctctttttttctttattagtcttgctagctgtctatcaattttgttgatcctttcaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatacatcccagagattctggtatgttgtgtctttgttctcgttggtttcaaagaacatctttatttctgccttcatttcgttatgtacccagtagtcattcaggagcaggttgttcagtttccatgaagttgagtggttttgagtgacattcttaatcctgagttctagtttgattgcactgtggtctgagagacagtttgttataatctctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattggtctgtctaatgttgacagtggggtgttaaagtctcccattattattgtgtgggagtctaagtctctttgtaggtcactcaggacttgctttatgaatctgaatgctcctgtattgggtgcatatatatttaggatagttagctcttcttgttgaattgatccctttaccattatgtaatggccttctttgtctcttttgatctttgctggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttcccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacattttggcatgattttgcagcagctggtacctgttgttcttttccatgtttagcgcttccttcaacagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgctgagagatccgctgttagtctgatgggcttccctttgagggtaacctgacctttctctctggctgctcttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggctccattctccccatcactttcaggtacaccaatcagacgtagatttggtcttttcacatagtcccatatttcttggaggctttgctcatttctttttattcttttttctctaaacttcccatctcacttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcttctaaagccttctctcagctcgtcaaagtcattctccatccagctttgtttcgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacgggaccctcagctgcaggtctgttggaataccctgccttgtgagatgtcagtgtgcccctgctggggggtgcctcccagttaggctgctcgggggtcaggggtcagggacccacttgaggaggcagtctgcccgttctcagatctccagctgcgtactgggagaaccactgctctcttcaaagctgtcagacagggacatttaagtctgcagaggttactgctgtctttttgtttgtctgtgccctgccctcagaggtggagcctacagaggcaggcaggcctccttgagctgtggtgggctccacccagttcgagcttcccggctgctttgtttacctaagcaagcctgggcaatggcgggcgcccctcccccaacctcgctgccgccttgcagtttgatctcagactgctgtgctagcaatcagggagactccgtgggcgtaggaccctccgagccaggtgcgggatagaatctcttggtgtgccgttttttaagccagtcggaaaagcgcagtattcgggtgggagtgacccgattttccaggtgtgtctgtcacccctttctttgactcagaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcggaaatcaccgtcttctgcgtcgctcacgctgggagctgtagaccagggctgttcctattcggccatcttggctcctcaaaaaaactgcttttttacacggaacccacgaacatgaaaaaataaaaaaaccttgattattagcctcaggtatgttcacaaaagtatagatatgtttttcatcattcatttccaaaaacattatcagagatttggagcaaaaaggtgctgttaccttatcattctgaagttttgtgtatgcctatgatgttggtataattttcattgttacaaccattatgatacttattcacagaaagcgtgcattaagcacttattgtgtgtcaggctttgtaataaattatggtgatacagagactgacttgctaggtccctaagatcccataatctagtttgagaagagtatggagaaggaacatgtaagcagttaaactgcaattcagagtgatcatcacagtattagagatgaacaggaagtgtgcctggagctctgaatactttcagccacttctaacctgaggagctagggaaaacttcagtatgtgcttacatttcacataaatctgaaacaattagaaattatttgttagagacatacatgtagctgtgtatgaggtaaagggaatagcacatttaaattcatagagtctaaaagtcgccatatgtgttccagtattattggagctcaagaaatgtgggaaagagactaggaagtgcagtcccagggagccttctctgatggcttgtgtggggaattgctgaataagctagaaagggtttatcaatctcgtgtaatgaagactcaatggagttttagccacaatatggagagctcacatgtgctattgaggtggttgtgttaactcttcttttttttttttttagatggagtcttgtgctgtcacccaggctggagtgctgtggcgcgatctcggctcactgcaagctccgcctcctgggttcacgccattctcctgcctcagcctcccaagtagctgggactacaggcgcccgccaccatgcctggctaatttttttgtgtatttttggtagaaacggggtttcaccgtgttagccaggatggtcttgatctcctgacctcgagatctgcccgcctcggcctcccaaagtgctgggattacaggcgtgagccactcgcacccggccgtgttaactcttagtaagtagtagaagccagtgtgaggtacagggagaccagacaggaggctgtttctatgtgtgagaaacttttatccactagaagttcatataaagacacatttgggaaataaagttgttgtagagaaagatacaccatccccaccgtggatagcatccagattaatgctggaaatcacatttcaattagaaaattgcttaggaaacatgatgtcagaagaaggagagccatgtaattcaagtctttggtggcatctctttcaagtttcccagtgcacctgactcagaagatagaatcagtctgttagctgaggtctctctgtgctggagaagcatgaaaagggccccaccagcatagactcagttctctttgaagtttaagatccatctacaaatggccatgttctttccttagcagaaggtattggggtttctacatacatgctactcactgctcacgtgtaagtaaggtaaaatttgagcaagtggaaaatgaccctgctgtaatccagatcataatatttctaaataagcacacacaatagtcaaccaacctacttcatgatcttttatggaacaaggcagagacaaggccactctgcacccacaaaaatgtataagtatgcacttctgacctatgtgaggtaagtgtctgctacttctctgtcaatggcaagccctactaccgtcctccagcatattggatttgtaggccactcagttagcaattgtcttcacttctacatagcattcaatccttaatgtactcctgcttttcttagcctatagagtagttcaaactcccagggaggctgttttgttagaaggaatgaagtcactatggatatattgaaaatctcatctacaatagttaaaagtccataatttagggttagtgtgaggatattcattcaataagtatttactgaataactattggatagcaggtgatgagttagttattaggaatacatatacccacatacatgcacaaacacacacacacatacagacacatacacagatatataacatgtttgtatcttccagaagcatacggtttatgggataaacaaagggagataatgaaggttattatttctagtagcaagtttgagaatatcccatagggtgaggctcatttttgttagactttgataaatcatctcaaaggctaggcctcccagacgtgtgtgttatctgtggctcaagactatgagtagcagtcatagctatgattgaaagaatgagagacaaagagcagaaagagtggggagtagttctgtgacctaaatggtgaaaaggccccagagaagaaagcctttactgggcaacactatagagagttttgtagagaacagaaatatccaatgggaatttattttttgctaaagttttctctgtcttataatatgttatctggatgaaatctgtggacaactgtgggattgtgggggtgcaaggtggcaacctgcagagcaaagcatgtgcaaaggcctgaggggacatgggaaatttaaacaattgtggcttgtgtattgaaagtggggggcagttattatgtatgagatgaggagtgagagacacagagggcttgggaagattttggtcttcatcgtaagagccgagataagccatgacatgattttttgaacagcagtgactgattgctatgtggtttttttttttttttgcatatattatggaaacagattttattgtaaataattcattttagggtgggtagcatgtgcacagacaggtctgtaaggaatattccaggtaagatgagatggaaagaagtggtaaattcaaaagatatttaggagttagaatcaagagtatttggtgattgcgcatgcaggatcaagagaatggctactaggtttctggcctggacaatgggatcagtggtgtcacattaactgagactgggagtgctaaagtgcaagtttcttgaggaagagcaagaattccattttctataagcaaattctgagctgcttttgggatgtccatcaagaggggaaagataagcacagtgtgctgcattgtgccagcaacatagaaacctccgtaagtaatattcaggttcaactcagtagttaatattcaggttcaactcagtagttaaggaagaaaccagtcatcgtttcaattcattaataaattaactttcattgcaaaatctgtggggatttctgtcttccaacccaacattttcttcccattttgcctttaatgaattcaccaccaccacctctcactgtgcatttaattactctactgattacttactatgtatgctacgtgatgtggaaagaatagaaaacttaaaagcaaagcactctccctgacctccctggggatagagaccgaaacgtataaaaaaaataagaaaacacattaaactacatgtaacaagtgccagatgagtgatccagataattgcacagtccctgtggcccctagtgatggggtactatttctaatgccagcagcagtgcttccttaaactgatccctagaccttggtcatggtgcttggaaaaccctttcttagcaccatctctgctcatcttaatcctaacactcctttattcttcctgtccctctttttttggaaaatcctttccaattgttttgctttgttttcttctcgtttgtcctctatgctgctgggctgatttttccctcctttaatgaaattccatgctctttctctaagttgttttggagcccttcttatatcctaacttacttcgcttcccagaaatttttaaaatagagtttttgttcactataacactttttttttttttttttttttttcctgttttgagacagggcctcactcagccctgtctcaaacaggctggggtgcagtggcgcaataccagctcactgcaacctcgacctcctgggctcaggtgatcctcccacctcagccttctgagtagctggggtcacaggcgtgcgccaccatgcccaaataatttattattattattatttgtatagatgggggtctccctatgttgtcgaggctggtcacagactcctgggttcaagtgatcctcccaccttggctcctgtagttctgagatacaggtgtgagccagagtgcctggcctgtgataccactttttaacacaaacaattagaaaaatgctgtataaaaaagttgtccttttttttttttttgacagagtttcgctcttgttacccaggctagagtgcaatggcgcaatctcagcccgctgcaacctccacctcatgggttcaagtgattctcctgcctcagccttccaagtaactgtgaatacaggtgcctgccaccatgcctggctaattttttgtatttttagtagagacagggtttcaccatgttggccaggctggtctccaactcctgatctcaggtgatccacccatcttggcctcccaaattgctatgattatggatgtgagccaccgcgctgggccaaaatttctcccttctgtaaattcctattccgtgcctctgtgtcatgccatccataagcccaaggattaaagatgtgaagacctgctctgctcagtggaagcaagctcatggtccagtcagacagtcagatgggagcttcagaagctgatggatgtggagagaatgatgtctgatagcagggcccactctgaaataagggaacttaaagaaagccttgaaatacaaattggtattcacgggaacataaggcccctcctgtttacttacaggaaccttcatccatataattgttttgaaggcaatagctctataacaaattatttaccaaattacattcctagaaacagaagtttgattaagtacatgccaaaatagtaccatatagcatagccagcttagtgtattggactgtcttaaaagtggcatagctttaaaaaatataaacaagcttccaaaagtgttgaatttgctcacagatgagagtttttgattactaagatacaccaaggttgtttaggatcataacttttatagtttggcattagatcttatccatgttctcattctcacaaatgttccgtgtttcttcttcagaataaaacactcagctggatacattagagcacactgtgccaccttagggcacagaaagaaaataaagaattgcaccttacattttatttttggctcattcttatttatgttctattttatgtgttttgtagtgtatcttgtatgttgaaaattaaacaaatagatgtatgaatacatacatgaactttaatcagatgtacaaatgtaggaggatatcatccaaaattattagcatctctttagtaggctttgtttggttgtaagtgatagaaaacctcagtaagagtgacttggacacagtatgcttattatttagtcaagaaaaatctaagtaggtggtcttagagttagcgtagcaacctcgtgagtttattaagggtccagaatttgcctatatttccatacacatattttgcatgatgactttcaagaataaaatttcacctcatgatgaattacacttaccttagccaatgcctctgtgatttcaggtgggtaatactatgtagataatatatagtaaaatgcataggtatattctaaggtttcaaatgtattgataattgcagttatttacttagagaatgatcatacccaatattttattattgtttattatattgtcattaaaaagttataataatgttgttttctttgaattcagtaaagtcattgtgaaggttaagcatgtgcattttaaattaatttggagattctttaagctatggaaatggaaagcctcagtacatgttaagcctgatatctgagctttcccaccccagacttttgcagagccattgacttgggtctctgatcctctgtaatgtgctgatagatgataacatgatggagaaatcagttggtagaatggggcggtaaccactagagatagcagttgtcagatggaaattaattgattgtaattgctttgccattgtattgcacttgaagtctgtagcttgttaaaaccactgattataaaataaggatctcactttttatgctgtagattatgttaatgaaagctgttcttagaagcatgatcagtgaatatcaataaatggataataagaaattaaaggaaaagttaactaactgatcatgagttaatatacttcagcagccagagtagcagtcaactgtgcaccgtttcatattgaattttttgctcagagctcttgaattttaaatatttcccatagagagattgattctgtgtgactgtttatcacgtactgtcttgaataacagatcttttctgtagagaatctcctgcaagatggaaaatgtgtgtgttttgcagagcctttattttgtgccaaagtattaacaagcagatattttgaaatggaaaacataagttcccattgcaataccaatagtggtttatttcagtgctcgtggaatatgagtaacatatgtgtgagggtctgtgtgaatctgaaggccttgctgttgcaatctttatcaatattataaaaagtatactaaaatgataacataaatgttaaattatacttcactttttgctgtacaaaatgcgttaacttttataaaattataatgaggtttttaattatagctttcatttatagcatttaattgttgatgttagagagatcagagattttggagatatttttctgaacaccagttctcattaagcctccatgcaggccctcaaggaccttacagaagaaaggaacagataaaacaaagaaaggattacttgcagtgttgaatgcagtgatgaaagtgataagaggcactgggaggcacaagatgagatcatctaagttctgaggatttctgggtgtcttcaacaaagaatgaaggtctgggaagaaggagcagtgtgacagttcttggtattttggggaaatagaatgatagttgaaaattaagttgcataaagttttagagtgcaagaagagaccagacagataaacatatagatggcccatgccctggtttgccctactgtggattttaaagttattcccacaggagagcccatgaggatttttagatgtgggagagacaggggtgagtttccttttaaactgctcgctcaccatcagttgtgacgataatcagggaagaagctcattgtgaccttcatttactgtcttagtccattttctattgctttaactgaatacccgaagctaggtaatttataaagaaaatacatttattttttgcagttttggaggctgggaagtctaaggtcaaggggctgcatctgctgagggcattcttgctggcaaggactctgcaagccctgaggcagtgcagggcatcacatggatagggagtaagagcatgtcaactcagtccttctttctcttcttgaacagccaacagttccatcatgggggcctcaccctgatgaccttatccattcctgattacctcccaaagggccccatcttcaaatatcatcaacatatgattttgaggattaattttccaacacatggaatttgggagacacattaaaacaagagcggttaataagctggtataatatcccatgcttgaatattattattaatctaaatctctgtaaaggaaattaaaagcttaagcattgaataattttttcttctttgactttttaagtatattttttgttgaatgttgtggtggaattggagctaatagttgcttaaaactctgtaattggaacaatgtctacatgtggtaatagagtctgtatcttatagatagcacttatttattgttattctcatatttgggatgcagatattgatgtataacttaatttgaaaatgtaagtaattatgattttaagaatgcatgtttaagatatgctaaaaaatggcaataattggtcctgttaaatatttaccagaaacattcttcatatttgagaatctgtttcagaatttagaacatttgcattttaattacataataaaaggagaaagtgaaagaataattggcttagctattagccaattatagctgtaactgaaaaaaaaatcccccaaactgacattggattccacagaacagtcacaatatacattgatcagatgtttaattatatttggcagcaataaagggaagggaatgttgtttcaatccttcatacaacatgtttgttaaaactgaaattaatgagggtggatttggggtgtttgacttaggatcattcagcttttagtgtttacttgtccacaaatggggcttctccagagtgactccaatagataaaatttagtggagaaataagacaattgaatatagtggttacagccagctgcatttggtcagtaccaaggagggttggagctgtctgtctagagtcccagaggtcagagcccatgagaaggcctccatacagagatccagagccagtgacaggagttgttggtgtcagaatgtactgctgacagcgtttccccctgtgctttccctgacagatacgacgacatattccacagagcgatccgagcacttcaaaccctgccgagacaaggaccttgcatactgtctcaatgatggcgagtgctttgtgatcgaaaccctgaccggatcccataaacactgtcggtaagccactgaggccactgatggaaagggcaggcccgttgcaaggcgtgggggtggagggtgctggcagcatctggtatgtgtcatatccgggatacacacagtcccaccgtttgaatagcagaattgcgagtcttaatttggaaagggcaaggctgctgcctctttaacagtggaagaagacaaaatggaaacaaagtagttacggtttaagttttacctgaccaagcaaacaaagatttacttttagatctgcaaagttaatggaaataattatttacacactttagaagcgtctgtttatgatgtggagcttaggcatatatcctagtactcagaaataatctgttcttgagaacctacagactgtggcaggagaagcaaactgctcatctaagatctagaatctcagtgtttattgtgaaccaaccccagagacttgaactgtgtccagagagaactgcattttattttgtttctgccttcctttattaatttcagtactttttcttaacacctctgatgaaacactctccagcaagaagttgtaaatgaaatagtagtcctgttatagtctaggtagagaactacttggggaaaactcccagtagagatcaggaaggtgtttaattggtttttagagacataaggttatgtaactgctaaaaataaaaacaaggggggataaagagtgcacttatagacactgtggctttaagactcaatagaagaatcaaattaacatctgaaaaatatttcttaccaagctttcatttccagtattaccctggtaatttgtttttctttgcaattgtgtatgcatcagtgatcatatatatccacaccccttttcttctctttatttactcttctcgtatgacacagttattaaattaattattctgaatagtgaggcatggaaaattatgacttttttctattactattataaaactctattcccatgttgtttcactaagatggtgtagagaaatgcattgtatagttatgaacttagaacatgccatgccagcagaagctgcctggatccaagagccaggtttagtccacagggaagatgtattgccacactgagcaatggcacaggtttggaagaacagatacgtgatatagtaggagggctctgtaaaagttaccatatgtcctgtgtcaggacaaatagaactgtgacctttcctcacccctgacatgtggtgttcatatatgactttggcagtgccgctgcattcaccctagttacaaaatttgcaccctattcctatgctctgcaaacctgggttggggaagaaggggagtggggattgtttctctccacactcctcctctctcatatttattgtgactgtgcatgtatggatacaaagcacacaagtgacattaagaccttaagggaaaatccaggaatgagctactccttcaaagcgtgatgtgcatgcaagctcttttagatcctcaaccatgttacagtggccaatctaatgggataatcatttggaagtggccaatgcaatcaattatgtttgaattcgtaatcaattgaagaagggatgaatcagaagcattagctaaagtagtggctttctttgatggtgttttaccaagaggaggaatcagatcaggtcccaccacagtatgcaggctgagatgattcatcttttccaaaaactgagactatcaggagaacaaagtaattcttctttttctgcatatggctatgctgtattcttcattacttcatgagtgtatgaatttgctaggactgctgttacaaagtgctacagactgggtggcttcactatggaaatttactttctcacagtcccggaggtcagaattccaagatcaaggtgtcagcagagttgattccttttgaggcctccctccttgacttatagatggtcaaggagatgtaccttattatgtttcctctgtaggtgtttgtgttcagagttgattccttttgaggcctccctccttgacttatagatggtcaaggagatgtatcttctcatcatgtttcctctgtaggtgtgtgtgttccaaatttcctctaaggacatcagccatattagattagatcacatcctcattaccttattttaacttcattacttctgtgaagacctttctccaaatatgatcacattctgaggaactggagtttacttcatgtagggattttatatttttgtagataaattcagtccataacaatgagtctcatgtccataaaagaaaaatcctttgcttttgtgagatgcatgtacatctctaatttttgtaacacacataagcagatatatacctatagtttaagtgaaatgatgtacatatttaataattttggccttctgtcttcatatttcttgcatatttcagtacagacagcctgttatttaacatagactcacaacatagctaatcatgacaaaagactagcctaagacaaaattggaactcgagtaggttaatagatgcctataaatctcctactggtgtgtatgaataaatcacacatcacatgtgcctgctattcatctctcaagctttgctgtgaataaaaggcttacatttgttcctgcatcagccacttctaaaaattccaatgtagttattaataaagtgccattttgtacagcactctatttaagtagtatgtttcagtcatactcctattcaacaaatgtttactgagcacctcctatcactaagatactattgaataaatacatacagaaatgaatttaaaaattaaatgtcacagtgctttgtaatgtgtttggagtaagaaaaatacttcatcgttaggaaattttaaaaagcaaaatacttcagtgactgacatgctaccaggagtatgtttatgacatagtagttactggattttgtttcaagttaaataagatgccatttaatagatctgagcagcaatataaaggcttatgcatgaccctggcttattcaatagtttatttttttgtgtctcaaaagattagacatctaaatctgaaagaaattaaaattatatttcctagattaaaaaaaattgtaatcctataataaactgcatcaaatatttttctgtgttgtgaaaatagaccatgctctgacacatttctgttttcttctcaaggaacgataagaacacaattaccaaactattcgtgatagaaatcctgaaagtacatgcaaaaaaaaaaaaaaaaaaaaaaaaaaaaaaggacaataataatcccagaaaagggaggagttgaaagtgggggacatgtttgtttcttcataattttcttattccagttcttcaagaaacacttgtggtaccagtacttagaaattataaagcaatttaattaaaaaaaaaaaacttgacagaaggatttttaaagaacaagaaatagagaaaatagattttcctaaattcaaaatataatgtgtatatatatatgtgtgtgtgtgtgtgtgtgtgtgtgtgtgtgtgtgtgtgtgtgtattttatttttctgagagggacccttgctctgtcactcaggttggagcacagtggtatgatcttggctcactgcagcctcaatctcctgagctcaggccattctccctacacagccttctgagtagctgggactacaggtgctcaccaccatgcccagataatttctgggtttttttttttttttttttttcgtagaaatggggcctcactaggttgcccaggctggtctccaactcctggacttaagtgatcctcctgcctcagcttcctaaaatgttgggattacaggtgtgagttactatgcccagcctgaaaatataaagccacagattatccacaggctaattagtgaaaacagattgtggtatattgtgggacttagtatagaacaaggcttgattcataaaccagaggaaaatgagagactgattgttcaataaatgattgactatcaggtaaatagaatcagaagtgtatgttgacccctctttctataccaaaagtatactaatgatttcaaaagttaatgtaataaacaaataaagcctaaggaaaataataagtaaaattacatgtttatttatgttcagcaattgtaaggaccttgtgagcaaataaaagcaatggaaggcaaaaattaacaactttgacacagcatttttttatctgaatatcataaatcagaaacaaaattaaaagacaaactgtgaggaaaccgaataacaaatatggcaaagaattaaaaccctgaagaagtcatgtagatcaaagggtaacattaaaataaaagctcaatagggaaattgacaaaggggaggaacataatctatctaaaaagaaatacagataaccagcaaacaaatatactcagcctcacagagaaatgcaaattaggtgtttttttcctatcctttatttaaagatttttaaaagtgactactatacccagtttggtaagggggctgtgaaaacacgtgtccacaaatactacttgagggagtgcactttgttaaatattttttgtaggtaatattttagtatgttttaaaagccttatactgttttttgtttgtttgtttgtttgtttgttttttgagacggagtctcgctctgtcacccaggctggagtgcggtggcgtgatctaggctcactgcaaactccgcttcccaggttcacgccattctcctgcctcagcctccctggtagctgggactacaggcacctgccaccacacctggctgattttttgtagttttttagtagagacggggtttcactgtgttagccaggatggtctcaatctcctgacctcgtgatccacccacctcagcctcccaaagtgctgggattacaggcgtgagccaccacacctggcccatagacatgcttgtgaatatttatttgtagggatgctcaccacatttttatctgtaatagcaaaaatttttaacaagtatgaattatgaatttaaatgtctatataaattagaatatatttgtacattgaatgaattttcacagtgttttgaggatatccaatggtcactatgtcatgttaggtataaaaatgtaatatgaaattgcaaacttgaacatatagtagaatcctaattctgaaaaaaaaactaaaaaggttgatagtttacaactatttccttctttcaacttggcaaattttctaacatctctatattacacatatatttcatttatgtaacacccggttaagagagttgactcctgcctctagtctttccattaagaaatatagatagtgtccttgtctctttaaaatcaaggtcattataattcactattattgagctgataagagaactttcaattaagtgcttccagattaagcactactaagtctatttgaatgtgtctgctccttcttttattaataattcattgatactttttataataattctttttcatgttgaaatcatgttttgaaaacattaaaaacattggatttaataaaaggtagatacaccccatagaaatgaagctggatgaagaaggaaaataagtcagcagaaacactttgaatcaaaatattctgaataaaatcagaatattctatgatcttttcatttttatgccatttctagaaattttaaaaatgttggcaatggtgctatgtataatatactgcactagattgaaaagaggtagccactgtaattgaaaagattgctacacatttgaatggaccaaatgtgttttaagaccaaattcaagtaaaaaggatgtgtctcttctgaactgaagctcattaaatgtttcaccggccttcctgcaaaaatggattttcaaaactttggaaaggatagcatttaagctgaatttgacctgtattgaccattttggaaatcagccaagcaattcgcttgaagatacttgaagcacttgaaatatggaattgctggaaaaagaataagacagcccaatagctaccattgcccagggtgatactttggtaacaggactgatggcttgtataacaatctgacatgctgataggagttggggagtgggggcagccattgggaagggcaaagggaaccctaagagtagttttttctccctattatgactggctgtctctgagtaggttttgaaataaaagcttccatttttaagagaattgattggtcattgcgtaacgacaattctacgatataacaggaccatcccagttagtgctttgccctgtcactttggaggtccattagctcttccattcagtgagggtcctctatatcaaatggttctccagtaagtgctctgagagcagcagctaatgattccctgtggttgaagcaagtcagaatgaaaatggagttttggcacacatccctgaattccatcgacaggagggaatgaaggctaaaatatctataaatccaggccaggctgcagagtcactgcagattccctgcagagtggtgttaataacaaggtgaagaaccttagaagaatttgcaagttcatcaaagaagtgttcatgggaatgattgccatagcccagacataatttaagtaatttgcaatagccatattgataacaggtggtctaccgattgcttttgacaagaggaaatgaagaaagttataattattcttcctctctgtggacatagcttgtcatgatagtcttagaaactcggaaagcaagcaaaccaacaacacaatgaatgttattttgtaattccatgacacttaagcagtggtttacctcttctaattcgacctctttgtattaaaattagttggcagttagtacattgctttggatatggatatttaagtatcatgcaaaaaaacaaaaaagcacattcaaccaacacatcatttagttattagccaaagattactttattttaatgttttcttctgtgattggaatttagttattagccaaagattactttattttaatgttttcttctgtgattggaatttagttattagccaaagattaccttattttaatgttttcttctgtgattagtggctctatctgaagcaggaaatggtgttttttaaggaggtcattatgacttgggtttgcttttgtatccaagaattgacacaaatttgtttatttaaaataccttccctgtgtgagttggggtaagacatacaagaggcaaatgtgagtgttcaaagctgagagacctgagttcaaagtcctactcagctttctactaactctgattttttgcaagtcatttaatcagaaccttcaatatttaatttttttaagatagtctaatagttgccccaaaaggccaatgaaagaattgaaagcaacatatagaaaactatgactgtgaaatagatactatgtatatatatgatagctctttcctctctcctttatgctcatattgaagccaaggaaaagcatatttcaagaatcccgtgagagaaattgtaccagtatcatctgccttatttaattaacaggagacttcggtttaaaagtggggaggggcatgccagagaattcctgtctactgtatattctcaggactcagaattcctatcgctaattttaatactttgacaaattagcaattttctattatttgttacattctgcaagcatttcttgatttttccctcattgcttttcttaacgactcttcatgggtttaaaggaaatattatttttcctttcctacttaatcagcgtaacgggccataattgtgtcaataacatgaaattgttgtcgattttgcaattttgtgacacaatacaataggctgttgacttttttatttttttattttttttgcagaaaagaaaaatacactttcatgtgaaaatgtacacactgaaaattatagattttacttgtggaaaatatatgattcaagaaaaatgaagtgatttacttttttcttaattctttcccaaaatagttttctgaaagtttagctatctgtatacttcagtgtttaaaatatgtaggcactaaaattcttaatggcataaaataaaaataatctgctttacgaaagcctacagaaaataatttaaaaggaacattttttaaacgcaggatatgttagcagcgaatatggaacccaagataagcaaggcgtgttcgactctacctagacagtgtcagatctctggcagttagtacattgctttggatatgtagcttttagctgctctcctttgtaagttttaagaccaggcttgtttatgtataactattcaatgtcatacacacacggagacgtgcacacactctttttgtttgctcccatgatgatttatttaccagctgtaaaatggggatgatgataactgtccttcctggcagtcattggaccataatatatgtgaatgtcaattggaagttgtaaaatgccatataaatgcaagatattgtagctatgcaaaacctaaaattacctaattgattttggtctgtcccttaacccttataatgagagtgctagcaactaaaacaccttgaaaattactggagtgtttttatagccaatagactccagaatttatatagcacttagaactttatcaaactttctttgtactagtctgattatttaaagaagatctcactatataatgatgtctttaaaatatttaattttaaaaagataaaaatctttttaaaagataaatattttttaaagataaataagaatatttttatttccttgcagactctttaaaaagtgttgtctttttgtcttctgtttttcctaataattcttatttggtctggctggttggattcaatgctccactgctactagcagacaaattatacatattcttgaccgaacgtggtggctcacgcttgtaatcccagaacttaggaggctgaggtgggcagatcacatgaccttgggagttcaagaccagcctggccaacgtggcaaaacccagtctccactaaaaatacaaaatattagccaggtgtggtgatgcatgcctgtaatctcagctacttgggaagctgaggcacaagagtcacttgaacctagaaggtggaactttcaaggatgcaataagccgagatcataccactgcactccagcctaggtgacagagtgagactccatctctaaataaataaataagtaaataaataaataaataaaacatattctctgtgattcagttttcttatctgtgaagtgggaaaaacaatattactacttcccaggattatttgaggcttgatataggtaaagttgagatgcctggtattgagtaaacacagggaatttggggtaagtccagtataatatagtaagttacaggtattgttactttatctgcacagctttgttgacaggtcagtgtacttgtgtcagaacttcttgataggtactcagagtctcccagcacagtgagtcttgtgcagagagttcaatttagatccactaatgggaataaaagagaacaggcacagatacattatttaaaaacacaataataccagatcgtgcacaagaacacattttagaatcaaggatcattgtaattattcaagtagtaaacttaaaagacaggcagaaataggaggccaccttttgttaggggaatgctcccttttgacagttcctgaagaaaaaacatgggaaaaacactccttaccacctacagtttaggccattcctgctgttgacccttcagatgtgtccccgaactgcctcaccaggcacctgcttcctgcctgagagtttcactatcttgtgagggatgggacagtctggaagcttctcccatgcagacagagcagagagagaattatgcaatattttgtatcccagataaaattatatagtttaagtggattatggattatttcaccaaatttattttaaaaattaagaacatatccataaatattattttagccagagatgatctatcagtacaaatgtgaacagtaaccttggtaccacaggccccgccgtgcaagcttcttgggtaaatatttcaataaaaccttctcaaaacaggataaagatggctcagctgttctgtggactctgccgaggcaatgagggaatttgccgtgtccttctgtggtctgcccatctctggggctactgaaaggattcttcctccaacctaagtttcacagcatcaggcagcacttctgggttcctgagcatgctatttctttccaaatcacttttgtctgatcatcatttacaaacataaaagatggcttaagggccaaatcacaatttttatgcgtaaaccaaaatgtcagtgtttgtgtaccagactagggaggctgacaccaggttctacatgcttcgcctccccactaaactctctcctttattgtcccagtggttcaggaattcaaactgcttcaaaataagacatttaaactctggctttatgtactctacttatttttagagataggttcttgctctattgcttaggttgcagtgcactggtacagtcatggctcactgcagccttgacctcctgggctcaagtgatcctccttcctcagcctcccaagtcactgggactacaagtgcacaccatcatgcctggctaattttttaaagtttttgtactggtggggtctcagtatgtggcccaggctggtcacaaactcctggccacaagtgatcctccttccttggcttcccaaagtgctgggattataggtgtaaaccacggtgcctggcttagctcccaaaacttttcaggcataatgggaaattttaataactttctctgtaaaataagcataatccaaggatgttccatgatgagtatgacatatacttgacctaattataatttgattacactcaaattcatagaaaagcaagactatcatatactatgtggatttttcttaatgtaactttcaccagaatgtacaacctctgtattgttatccccactttgcagaaatcagctgtgagtttcctgagtcactcagtgctagcaggctttggatgataatgaaacgagagagttccctgacatatgacaggggtgtggctcacctgtttttggtcgtcccccagctgaaacccctgaaggaggggaagcatgcagaagggcagtgcagaggcgggggcaggtgctttggctccacagtggtgtctggaggtggatacctgcaaccctccacgttacaaagctctttcagttttgccatctgcagatggcttgagtgttaatcagctcagtggaccctctgctttatcgcaagggcagggggccagtgtgacagccttctgtatcccaagctcttgcccagtggctcagaagaattggatcacatgcaggctggaaggatgagtgcaaggttttgttgagtggtggaggtggctctcagcgagatgatgaggagctgaaagtggggatggagtgggaaggtgatattcccctggagtggggctgcccagtggccagcctcctccagtcaccccctgctgaactcccctcagcatccagacatccctcctcttctctttctctgccgcgtcgttctgccattgctgatctgctggtctgccctggagcttgtggttcagggtttatatgggggcaggataggggaatggaaagccaaaaggcaactttttgggcatgaaaacagaaatgcctattcttattcagggatgcgggcatctaggcttaaaggtggggcctttgccagggaaccaccctcttcaacccagtattttcccatttcctgtccgtatcaataaggtagaagagagcgccctaaaacccattcttttcactgtatcccaactctgtgtcagtgcacgttaacatccaactactcttttatttcgttacctatgtacctacgtattacttgagaaaactaaaaaattgacagaagggccaagcattccttgttttatagaaaaaagccaaagacagtgtttccagagtttatctcagagtaaatctctaaaaatatgtttatttttttaatgctcacagcgattctggtggctttatgaatatcaggaaaatatttctactaaaggcagcttaaaatccaccttacaaacacacacacacacacacacacacacattcacacacatgcatatacacacagtctgtttactaggtatctggcatcatgcaagacactgaggttcagtggcaaatgagaccaaaagttccttcttgtcaataacttgctataagagcactgggaagccaacagaatctagtgtggaagggaacacaatgggcagattctgaccatactgggcagtgaagctcatatttgggattatagggaaacgcattctaggctggtaaactgagggaaaatatcttcctcaactatataaaatccctcatgcaagttttatcaaatgagaaattaaggataaagtgaaaggaataaaaaagatgagagcattacacctggtttggggaatatgtttttagaaatatacatgccatatgtgaggctatagaatggcactttttgttctattttatgtacactcagaagtaaatgacaatttaatacattcttttatcattctgccaatgtttattaagcattttcaatgttccgagtccactgtaaagtggtaagaatatagtgatgaatgttctcagaaaaactcataagagaggggttgagttggatattttctacttcaattcaatatgacaagttctgtgatagatatgagctatgctcatatctgttttgtgttgctgtaaaggaatacctgaggctgggtaatttataaagaaaaaaaaggtttctttggctcatgattctgatagttgggaggttcatgattgggcatctgcatttggtgaaggtctcagggtgcttccactcctggaggaaggtgaaggggagcattatgtgcagagatcacacaaggaaagagggaaccagtggtgaggtgccaggcttttttcaacacacagttctcttgggaactaaagaatgagagcgcactctcctctgagggaaggcatcaatctgttaatgagacatctgctctcatgactcaaatacctcccaataggcccctcctcccaacacccccacaatgggggtctaatttcaacatgagagtatgtggggacaaacaaaccatatccaaatcatagcactcatatgtacatagaagattccaaaaatcagtgctcatgaagccaggacgggcttcagagaggagataacacattaatttgcatttggaaagataagagcctttttatttctcatttggaagcctactcttgctggccaacaaaggcttggagagttgagctgctattggagaagtttctctttaaatccaagagggagggaaatttcaaaattactttagatgcaattagaagtaatcagcttcatgtcataaatttttgatgcaattggtcccttcctttctggattattttttctctcatgtccagatggttctcacaaacatatcagaagatgatgacatttttaatttctttcactcaagctctgaatttatctgaatggaaagtatagagaagagtgcgattcttcaagcctaacaagtatatcacactgattaaattatgaaattaagattttttaaattcaaaattaatgtataacttttatctacatatttgagatattcacaaagacaattttattgttccaatcaaaaattaattgtattaacattttattattcatgtatttatttatcctgagagtcttgctgtgttgcccaggccagagtacagtggggcaattttggctcactgcaacctccacctccctgggtcaagcaattctcctgcctcagcctcccacctagctgagattacaggcatgcaccaccatgctcagctaattgtagtatttttagtaaagacagggtttcgccatgttggccaggctggtctcaaactccaggcctcaagggatccactcaccttggcctccctaagtgctgggattacgggcatgcgccaccacacctggcctgtattagcattttagatgtaggaaatgatttttcagttctaaaattttcctaaagaattaaacatatccacttaaggatgcgttgaccactgatcattgttgaataatgaaactttagggatacttactggcacattcaagtgaaaatgttctacaattccctaggtagtatttcttttctctaactgagctgctgcgaggctcgcatagggtgaaagtaaggtaactgtaaaggatgtaccttgttatgggtcaggcagcaggttaccatattggcacatatagcaacacatgcatacagcagagatcagagaaagaaagtttgtaagaattcctaaaacaggatagctttctagtttctcaaatactgctttctgatttaaacaaatccaaaatacagttatagctaacgtcagagaaaggagttattaattcagctgtagaccattaaacaaacagaccccaggcttaggggcagatgggatgcttggagatgtggatgtggagagacaaaggcaatgccaagaggccagtgtgcttagagcctggcctccctggagtcctctgacagcaggtggatcccaatgaccctgtgctcctgaagggcagaaattcaattaggaactctcaactttcagctttgaggctcaggctagtgtatcagtgggtagctccactgctggaggaaaaacattctgcagcagttatgaaatagaggctaataataggacaagggagagtgaaaaacatgaggttggaaagcattggcagaaaagatgagctgataaagtatctactttaaataaggtcataattttgccacagtttggggtgttctcctgtgctaatttatagtcacaatcaaaatcacatggaagccttattttctttgacaaggttttattttcagtgcactagaaagctctttcctttctgcctgggttagcatatgtgaaagaaatagtgattattttaatgatattaaatagtagctttgatctcttccccctacaagctaaccaaaacattatctggatgtatgaaatgattcctttgtgagcaaaacctctgtatctattataatgtttttgttcatctacctgaatctcccactaggctttgagttcatctgtgcttccggaacctaccacctactcaggaaagataaactggatcaatgaaaaatacgctaaatacctaccactctcattttttagacgacaaatttgaggtgttaaaaatgagacagaaatgttaatatcaatcttctatttcaaacctactaagcccaaggcaaaagcttacaccctttctacactgcttcataattgcctaccttgtgttcatgttaaatatgcaaagaaacgttgtatccacatttgatacatgacaagaaggagactcccagagggaaggtcgcttcctcaaagacgcccaccagtaggtaggaggtctgatcgccagtctcagttctgcctgactctaaagctctcgatcctccaatcttgtcaaatttgctttattataagaatcaccaaaggccatggttataaatatagattctcaagatcttcctctgaagattctaatttaggtatcagctgggacccaataatcacgcattcattgttgagaccaatttgggaaacagtgaataagactagtgtttctcaaactctagtgagtgtatgaatcctgtggggatcaactgcagattacggtacagtggtaggtctggggtggggcctggggttctatgtttccaacaaggtcgcaagtgatgactgtgctgtgggtccacagccgcacttgaagcagtgaggaactaagccttgctgctcagctcacaataggacccttattcccaccctagaggtcctttagtaattctgccactaccacacaccctccaactctgtgcagcccagcaattatgccagagcaagctttcctgcatacccttgtaaacatgtttgtgaagcttatggaaacgtctgtttatctgtatgagttaccctgctagttcacatacctaccaaataagaatctctgggcacctgcgacacaacttcatcccatgcccatctcatccacgatggttttaaaagccaactgtttccacaggtttctattataacagggggattttatagatcacatttgctattcacaggtttagcctggacaactgatatttttcccaaacagtagaacttttaagttgggggaaaaatgttctctgcagcattcagataaatggatgaagaagcacttcttagaggttgccaatcatcacacctctgcaggacttaagttcatctaggataactcacccgaggctttaaaaaattactgatttttagctgggtgcggtggctcatgcctgtaatcccagcactttgggaggccgaggcgggcggatcacgaggtcaggagatggagaccatcctggctaacacggtaaaaccccgtctctattaaaaatacaaaaaattaaccgggcgtggtggcaggtgcctgtagtcccagctaccagggaggctgaggcaggagaatggcgtgaacctgggaggcggagcttgcagtgagctgagatcgtgccaccgcactccagcctgggcgacagagtgagactccatctcaaaaaaaaaaaaaaattactgatattttttataactaggaaagctgtaatgtgtaaacatgacaaaacgccaaaacgctaagtgaattttacaatggaacatggacttttcaaagggacgattctgattagtgaaatctgttctaaacctcggcttttctgattcctagcagggtgacccttggtaatatcttagctccagtggaccttaatttcttcattgtgaaatggcgtgattgaacataattcctaggtctcctcgaattctaaattcaggtgaagaaacagggtgatccgtcgcaatttcatctgtttcagtatatgcgtttatgacatttgtatcaaagaaaagtggagacatttcagaaacagcaagtatttcctgagaaaacatagctgttctatgtgttgaagcacaaaagataaaatgccaaattaagaagggtgtgactgtcaggggaaagacggcacacagaaaacctgttagtccttcatgccagtgcctcacagactggctatctactcacctgagcagcttttaaaaatccattctgtttcagtaggtctggggtggggatgaaattctgcatttctaacaagggtctgggttccaggggtgtcgctgaacgtgcgtctggccttatctagcaaggctttacaccggagctcttccactttagctgcagagttgaactggccagattcaacattcagatagcccgaacacatgcagagcaaacaaatttggatctctgtaagtgggactaaggcatttgtcttttaaagctgcctaagtgatttccatgggtagccctggttgagaatccctgctctactcttctgccacaggcctccactggggcttcccaggtccttgaaactttgggtttcgtttatttatgaacacatttatcacaatggtagaatacaaaataggtatttcaccctcactttaccataaccagtagagtgaaaccgactgtgccaagagatcatgctatttatctggtggggtcctttacacactcacagaattttccagaggtggtccttatgaagcagactgactttttattctgctccccaagcaccaatgctaccactaacaccgcttgtggcatatttccccatggctacatgggtctccataattgtcaccttcaagttacctgttaccatgctggtcaccatacccatgtttagtaaggttttccatggctgcatgtttacaagctttctgatcatctttcccttttccttctcatcctcactcttttcattctccctcttccttctatgcatattcattgagtacctgctctctgtctagcctatgctaggtgcttcattgcaatctgtacatggatgaagtacttatcttctactgcttctttggaattgaatactaagagtgaaattacttggtccaggaacatgaatatgttcatgactcttaacccaaatctctcttgcctgcattcggtaagcttctatttgctgattgaatatgtgtaagcttgcccctccttattatttaatgcttatgtctttgattgatgtatattttttatattctttatttggctgtaatgtgaatttaaattttacttttttctttaatagtgaatgctttaaaggcaatgagaaaccaataaagaatattaagcgatcgaataacttgctcattttatgcatgtgtcatatattttcatcttcagaagctaccagttcattctctgtataggcagggacaacaaggatgcctcgcagtaaatattctttgatttcaccagagcctcttagctttgcaaatatgagacatacatgcatcatggtcctgcaggatgagggtaagtaatctgagagaaagagagagagaggtgtatgtgtgtgtgtgcgcgtgtgtgtgtgtgtgtgtgtgtgcgcgagcgcacatgcgtgagttcatcagcctgcccgacaagggataacgtaacataatactcaagttctgggagggtagagaccaagactctaaaccgtgtccttccaaattcaaagccaacaggacttgtttgagaagagcagtgaccttattgagatcaatggcaggaagggacaccaagagcacaaaggggaaatgactaggagaccaggaaggagtcagatggtgacccaggcttaaatctaaacctagagaacagtcatggtgtgtctgtattgtcacatggtgaaagtgaatcaggctttcctggcttccctgctttgggcttttgagggtgtgtcgtataatcctgggaggctgggatttctgcaaataacgtttacaaatcaggttggattgggatttttggaggattaccacttctgtcactggtgccaccttgtggcaaatgctacagtaaaaacttgctgtagtgtaaccgatagaatttgaccatcatttcttttactaggcgtttgggctaggaagtgagaacaaatctaatatttggataaccagtgaaggggaaatcttgagctttcagtcactaaggataggtggaggttttagaactctcttaaattatttatacaggattgtttcgtttgttttttcttacttgttcagggagatctgaatagttgtaggggagagaatgaattggaggagtttctacctaaatgttaaacctcctccacactccccaacatcaacctggaaaagttacagagggaaagcattaagacatggaaaacattctgagaaactccagtgaaatacgtctgtgggagacaggaactgttgtgaacttggagtacgtgtgatttgaagcctagagcaggaggcagctcatggggctctggagctctggctctaagccagcaaagactgattcactttcaccatgtggcaatgcagaagcagctgggttgttctccaagttgtagatttaagcctggatccctgtaacttagggaaagagttgatggaattttctttctttgcttctttccttccttccttccctccattcctccctccctctcttctcttctactctcttctcttttttcttttcttttctttctttttgacagagttttgctctgttgcccaggctggagtgcggtggtgcgatcttggctcactgcaacctccacctcctgggttcaagcgattctcctgtctcagcctcccaagtagctgggattacaggtgtgtgccaccacacctggctaatttttgtattttttatagagacggggtttcatcatattggtcaggctggtctcaaactccagacctcaggtgatccacccacctcggcctcccaaagtgctgggattacaggcatgagccgccgcgcctggctgctgatggaattttctcttgcttctctccttctatggcctggtgtgctatatcactcacactagggaggctcagactataaggataagagcactagaagatctgagtagtattcgtggatggagagcagaggggacacaggtgggagctaattgggcgcaggcagccatttccccatccttctttctccaaatcctgataagtgatggactgcacccaaaggagtgtttcttcctcaggatgttccccctgggagattgaacatgaagcctggacctaagaaatggtttggtagtgttgagaggggttaactgtggcttcctggcacctgtgactctcacttcaagctcatcccatttccactctaacaccgtaggaggactgcaagtctaacgaagtctagccatggccccttttacattttcattgcctgaaaaattagccaacgcttggggggaaatgagcttcacaggcccaaataatgacagaggagcagcactatttcaaaagaacatgaattagagaaaatctttagaccaaggaaaggaaacagagacaatgatctaaagaagcgagaattgaaagagagaatactagatagatttgaaaaagataatccacagtaaaatgggtgcgataataacaatccttgctttactggactattatgaggattaaatgaattgatatatgcggtgcataggctataaagtgtttaaacatggagtataataaatattcactcttatgaaattttatattttgactcaaatgtagaatttggggaagaaggactctggtttaatatattgagtgtgaagttctaattggacattagtatctttgtatatatgtatattacatttgaagctcaatgtaaactgggccagaagtataaaaccagtggtttggcataaactgtctctgacattgtaggagaaaacttcaagtggaatggaagccttaacagtgatgtttgtagggcataaaaaaaaaggtttcctgaagaaaggtaggcagattcaacaaaatgaacaatccaaaaaaaaaaaaaaagaaaaaaaggaaaaacaaaaaagccacaaattcaactacttttataatattctcaaatgcaattttataatattcaatattaaattgtgtgaaataggagagcaaaagttttgttgccattcctcaatcctcctcaccaaggtttaaccacagtttgttggatatttaccctcagttctttttttatgtctaaaaaaaagacatgttttactcagtgtacatgtggagctttttacttatggcttcagggatctaactcatttcttaaaatgactatgttgcattccaaggatgaaaatacacactatttctaactatttttctatagacaagcagatcagattttttttgcaattaacgctgtagtaaaacttttaaaaatacgtattactcttgagttattggaacttattcacaaaaaaggtaattaagttccagttaaccagtatgtatagattctataatctgcccagaaacatgctaagtactgtatataaagcatcattgtgaaagataaaggcagtgagtattttaagaagaaggagtgattagcaatgtcaaacgcagcaatccagtagaaatacccatggatttagcaagaagtcaattgagataaaaataagagctatttgaattgtactatgtagtaagatggcagatttcaattagttaaggtgtcattagagatgggaaagtatagaaatgagtacagattaacactgaaacaaattatcttcatatacctatttgacgggaaaaacatatttttgagggattctagtagaagtgtacattggtataacaactttggaaaacagtttgttattaccaccagtcacattgcacatgtacctacactgtaactaatcacttcctctcccagagaaattcttaatattaacactccagaagacatggacaagaattcctagaataaattttgtaataacccctaatggaaacagccagattttcattaatagtagaatggcagcggattacattcatacaatggaatgccatccagcaatgctaatacctacaggtaaccacatggatgaaccacagaggtataatattaaatgcaaaaagcaagatttgtaagaagatgcagtatgatttctgttagacaaagttaaaaggcaagcagacaaaatggaatattgtaaaataataaatagcagcaagggaaccgtcatcaaaaaaggcaggttaatagttggtgttttgggggaaggaagaagattccatcaattaaagatgcatagagggctcctgaatccagcatgtttcattttctgacacagcggtttttgtatgtaatggtgatgttaatgatgataatgattaaagatcttctttaagaatggaatatgttgtaatggaaaacgacaacattacagagataacaataactaacatctattgatccttttgtattctggacactattctgaatgcttatttaatccttataaaaatcctttaagataaacatagctatcataccccattttatagtagaagaagctgagatacaaagcagttaagtaactcgtccaagcggcagagcaagaaggcgatcagcctccagagcttagattctcaacaacgtgtacaagattacctctgaaagactgaaaagctatttcatttgtgctttgatttttatatctaggtaactttgtagtcaatattttactctatttgtgagatttatatcttaataaacttttctcatattttattttatcacttatgcttcatgggttgggagactttatcacactaaatgagacacctttgagagtaagatgctataaacaatactcttggaaaacaagcataagctgggactgtcctggacaaactggaacacatggtcacctttcatagcaagaaggtgataatgcagcaaggccactactgatgaattctttcctttcttgtgttaacgtgttgcttatcacgtgagtttttgtatgtgtgtgtacttatgaacattctctttagtttggtttaaaccatatttgctcttttatgccatttcatattgctttaattaactttacttttaggagattttaattcctagcagtataagttctttttcttcactgttacactttatccaaatataatttgataatttaaaaatttttaaaaacatattttcctgttttataattgttttatttgtattacctttatagaaatacaattttattatgtttatagagtgcacatggaaaagaaaaatttgcagcccatgggatcattactattaattgctttgccttccagtcttggccagaaatattcatctttataatatttcattttatccttctcatatgtagtatttctgtgcatttattcaaatgtttttataatacttcctttagtagcttataggtttttatggactcattcaaatcccttaataattattttatcaggaatcttctcattgcttaactagtatgtgataactagttaagcacaaatttgtgttttataatgataaaggaaaggcacaaatttttgtatttttatttatatctagttaccttatgtactaaacatttttgttaggtagattttgaattgtctgccttttgcaggcctgtaatcctgcaatataaaaatagtgcatctttgtttcatagacttttgttaattttttaaaaatccagttctcacatactattttattgatccagcagtcgaaaccgatattaaatatgttaaagcttattaaaggtcccattattgtatataagactgtaaagtagttatctgtacattttatacataatgcatatgtataaatatattttaggcatagacataaatttctgcatagtcctttttatcaaaacccattcaatggagtactttattctcattaagctattcatatggtgtattaaactaatagttttgcctgtatagaaatattcttgaattcataggatgaatttaatcctactgcttaattgcaacctctaataatgtacttaagactttaatttaatattcattagtgagattggcctggcctaattcttattaaagctttattacattagatatcagttggcttttatttcacggaataccttcaaaaaggccttcatttattcattacatattctggcaatttgtgtaacactggtattaaagtttgtttatattttaaatgaattttccaataaatgaatccaccatatttgttttcggtagggtaattttttgacagcttcccaattctcatctctgctaacatttttcttttctataattcaggactgcattgtacatttatgtaatttttttcataaaatcaaaatttgtttatatcttctctctcttaaatgtttaagattttctgtccccaaatgagtgcatttagtaggctgttgcacatactatcagaaattccatgaattcatacctaaatttatttacttatttaaacaatttatgtttttccttttttaaaaaaaacacattttctttagcattgactcatttttgtgtaatttttggttaaattaggttacatgttttgtttgcttttacatttttaataatgaaagtacttaacaccatgattgtttttgctgagtgtgtataattgcttagttggttgttttaatagaattgttactatgtttttatttattttctccttcactcaattgttatttggtaaagagattaaaaatataaaagaggggattactatttaaatttttatctcaaagtttatgttacagtaatctgacattgtgatctgtaagcatagagactgcatttatacatctctacagctaaatttactgattttagaatgaggaagaattttcacaatggttaaataaatgataatttttctaaatgttttattaaaaactcaatgttcacagatacaaaattcaaactcttactatttaattatcctggttaaatatgtttctcattcttttatgtctttttatttttatcaagtggatgtgtttatgataatttatcttctcctatacttaaatattttaaaaacaattttactgcatcactaaacattaatctgctattcctttcaaatgaaacctttttgacagataattttgaatataattttatcactttttaaactgtcattattaattcacttaataccttaataccattatattaatattgacaaacttatttaattttattcacatttgagtcatctgatttttttctccatttgaaaaatgtctttaagttgtttgggtttttctttttctctaaatgcaaaacttgaaactataaaactttattttagtttttttttattttcaacttttattgtaaattcagaggtacatgtgcaggatgttacataggtaaaaatgttacatatgtaaaaatgtgccatggtggtttgctgcacagatcatcccgtcacccagaatccattagctattcttcctgatcctcttgatcctcccaacccccaccctctgacaggcccaagtgtgtgttattcccctcatgtgtccatgtgttattatcatttagttcccacttataagttagaatatgcagtatttggttttctgtttctgcattcgtctgctaagggtaatggcctccagttgcacacatgtccctgcagagaaaatgatctcattcctttttatggctgtatagtattccatggtgtatatgtgccacattttctttatatagtctatcattgatggtcatttaggttgattccatgtgtttgttattgtgagtagtgatgccatgaaaatacacatgcttgtgtctttataatagaaagatttatattcctttgggtatatacccagtaatgggattgtgggttgaatgatatttctgcctctaggtctttgaggaattgccatactgtcttccacaatggttgaactaatttacactcccaccaacagtgtaaaaacattaatttttctccacaacctcgccaacatctgttgttttttgccttcttaataaaaccattctccagcatctgttgtttttgcctttttaataaaaccattctaactggtatgaaatggtatctcattgtgatttgatttgcatttctttaatgatcagtgatgttgagctttttatttatgtttgttggccacatgtatgtcttcttttgcgaaatgtctgttcatgtcctttgcccacattttaaaggggttatttttttcttgctaatttgttaagttttttatagatattgtacgttagatctttgtcacatgcatactttgcaaagttttctcccgttctgtttctgtaggttgtttgtttacattgttgatagcttcttttgctgtgcagaagctctttagttttttcattatatatttagatttattgactgtatttattatacctattttcttctcagacaatcaagaataacaataatagctacaaagttctcttggaggaaagatataaaaaatacttcttgagcaaatattgtgccattaatatgcaaagtgtatagaatgatattcactggtaggcaggtctcaaatggtgtggagcaagcaccttttccaaaacatttctcatggtttttcttcttcactgagattgaattagattaagcgtaattaaaaatggagagactctatacaaggaataaggagggcaatattttataggtaagtatgcgagagtatatgaaattggggatttttgctataaagaggggattgttgctatagacagtaaattgatatgattttagatacaattataggatacaaattttgtttacaaatatttagtaaggtgtgtttataaaatgggttgtcctgctgaaaattgtaaaggggcaagaggtatagtgaaaaagaaaaataaaggcaaaagccaagcataatgttttagctattaaaccacatttctgcttttcatgttgtcttaaagtgagcatatattcattcttgcaattaggagtatttgattgtaaaactgctaaatacaaaaaaataaaacagataaatatagagtaatgctagcaagtagtaattcagttgaaggaaaaaaaatcacatcagtgaaatcacttttccatgaggcttttccatcaaatataaatttttatatagtttaagcacatttgtttacttttattcctcattattctaccctctctggtctagaataagtctaacatgggcatttttaaaaggccatacatatttaaacgaaaatgaaaagattaataactgtgcaagtattgaaactttaattatataaattctcaggcatgaaagtgttctttggcatttggctgtatgtaccattacttgtaatatggctccttattaaaagtcttttttatgcaagaagataaataatacaaacatcaacaatagagtggcatgggtttatttagatattaaactgttaattatgtatttgtcaaaaatcataaatcaggacaagttgagctggagaatgaaatattcagcctaggtctcattgtcatcataaattcctaattttggtttaaattaaggtatggacaagagtcttcatagaaacattttcaactcttctcttcttattcctttctcattttctctaaagaaatcttatcgaacatttaatctcaaaggtcatgaaaaagtatgattgacccatattgaagatatttttactactttcctttatactcggaaagatccactttttcagagacacattaaaaataactacccactaatatgtcttatcaaattacttcttggaggctgttattctaaacacaggagttagttcagtcttggcaggttttctttttctcttctttttatttatttatttatttatttttgagatggaggcctgctctgtcgcccaggctggagtgcagtggcatgatctcagctcactgcaacctcctcctcccgggttcaagctattctcctgcctcagcctctggagtagctgggtttacaggcacacagtaacacgcccagctaatttttgtatttttagtagatatgggatctcaccatgttggccaggttggtctcgaactcctgacttcaagtgatctgcccgccttggcctcacaaagtgctgggattataggcgtaagccaccgcacccagccttgacaggcttttccaatacaccatgtcatatttcatttttgccaattatgttacatgctttagctttattttatttttttctttttcttatggaaaatggaaacagaactgcttttacttttaaacttatattggcttgttttaactcctcttatgttttatcataaaacactcaaaatatatatgcttttaattccaatccgctcattgtcttaaattgtattttcaaggaaagaatggaatgcacacaactgctttgattgtcatttctatttccagttactcatgtaatggcactgccaggctggttggttggcattgtcttaggtgacgcatggaccatttcccctgtcttccagctgtgggcgttataacattcttgtttttcagaatgccagtgaatgtaccctaacaaacaagaaaaggaaagactgaccaaatctgaacattttttagctggaaaacatgtaaatttaatacttttaatagatgaaccctcatgttagcatgcaaattagctgttcctaccaagtcaattggaatgtgacagttaattctatacatgcatcagcaatgacctcagaattggctgtccatcaacttccatggctatgaactcacccaccatctttgttctagaaagactttccattaaaaatgtaagttcatgattaaatcaaaataagataaggggattattttaacattaatataacaccagaaattacatttgtttctgtggaggaatgctctgtttgctttggaaagaatgcagatccttttcatttatacagagataatatatatttttaacctgtcagaatggcaaagaacaaagttggatagcatgttgttgatgagcaggtgggagcatacatatatgtataagtataaattgctacaatgaagggcaatctgtttctaaattagaaaagtactgatcctgtgacccagaaatttcatttctaagattagatcttacatatatcctagtatcataaaaatgattccacaacacaattactcatcacttcactgaaacaacaaaatattggcaacaattgctcatcaacaagagattcattaaaaaacattatgggactctcatgtgggatataataatgtgctgtaaaaagggaataagaaagtttttttatgaacaaatgtggacccatttgctgagattattttaaatcaaaggaaaccaaggtaaaatgtaactatttacgtaaaaagagaatgtatttgcttgtgtatggattttatatatgaatgatatctctaaaattacatctgagaaactagaagtattggtgactagtggagaaggaaaataggtggctgtgatcaagatgtgagacaggtaatttgctatagaaccctggatttccctttaaaaataataaaattaatttaagatcatgtaatatggtaaatatttggactgctgatacttctttaaaaatcagtaaactttgaattgtgtacatttataacaaacatcctggcctctaaatatgtgaagaagtgcagaaatcatatcagtggtaaaaaaggaattagtacaagatttcatcttagagcatccagactctaaattgatagatatgtaagaatgaaagtttatttaaagtggaataatgtatacctcttcctgtgtccccaagatggcatcatctttctaacattgattcagcttgggcttgagtgtctgagctgtgtctcacaaactaagctctccataccatcggcatcaaagtcatttgctggagtgtgttaaaataaatattttcgaattctatcccatacctgccgagtcagtgggccttggaaaggagcccgggaatctgcattttacaaaagatcctcaggttagtcttaaaccaagattctagaaccactgttgtaaagcctggggaatagagaggagaaaatactagaactactcattaactggttagcacatgatggcatcttcttacaaacctttgtgtgcattcacccccctaaccacaaagcaaaatgagcatcagaaccttcatttaaagacaggaaaattaagtatttgtctttgtgtaattaagtgacttgccacaggtgacagagcgagagaatgcaaatcagaattcaactcgcaaatttctgctttgtccatgctgacaggaatagcatcattgtaaataaaaatcactgtgttagtgtaactttgaaaagtcaatccctcagtaaaccttgctctgcagtggaaggtcatgcctttctcagcctttcactacctaggattcacaggagatcaaatactttgctaaaaagagattttcttattttacttcacattctcatatctttatgcattactctcatttattcttcagagaacattctgctcagattaacttctgtaagcaacaagtatcccacatatattttcaacggccagctagctattcttaacaggaagaaaaaaatacaaacattggtgtgtactttttatatggcagtagacaaacgagggtaactggtgaatatataagttaatattctgaattaataaaatgaagacacattttgaaatcaacattacaggtaatatccaataaatagctttatacatatacacacactcatacatgtatatatgggtagtttctggacttaaaatagattcaaaaaagtttccattatgtaccagaacaatagctggtcttagggagatgagaacacatgtagagtctgactttatgaagtcattgacattaacacgtatgataactctcaattgtgaaagttaattctgtcagaaatgctgtgtgacaggcctattagagcggctacttgggccatttattgtactgtggcctatttccgacaagtcagataaaccatggtttgaatctccactcagtcaaaactgcagctagtcacttaaccacactggtgttcaatttactgtctgtgtagtgaattgaacatacctacctcaatgcgtttttatgggaataaaacaagagtacaaacctatctgtccactagtggtattttttaccttaagtcacattccttcaccactaatagtggttaagttttctgactctcagtgatccattttcaaaaggccatctctgaaatttttgcctctactttctttaatggcatttccctatgtcactgcttaggtgatatgatttaggggaaagccatattttacttgagttaaagtcaagtttgtttgtgtttttttgtgggggggctggggtggattgttctcaaaatgatttactgacattctccagcataagttttaggtgaaagagtattctcaggtgggaaatttgagtaaatcttgaggaagaagtatattctttacaaatcatttagggaaaattctctttaaatagggggacctacttatgcatctgatttgcccgtgacactcattgtttacactttcacacctacataattattaataatgctcttttactttcaaaaatgtgtagtttgaataaggtgtatgaaccacctaattgaagaaagttacttgtcttaacctagaggttagctagctagcatcaagagtttaggggaccaaaaatggtaactctctaggaaataaaaagaggaattcatctacttctctgcagaagaggactggtaaatggactaactttgcattcaggttgtaattagacaaaacagaaagtgtgatcaataatgcaagtgcatagtggcagaagagagcatggtgaagtgagcctgtagacacacttgtgcaatatggggacagctctgatgtggcctgggctgtggaattcagtttagggggaagtgggttgggagtagtggtaaagatgaagtgagtggattgggccctggcttccggattacaaatgtacttttggaaaaacaagattttgaatagtgtgggtgtctatgtaattactaaacaaggacattttttagcttttggctcaagtgacaaagattttcctttcaaaagcattttgccagattgaaatctaaacataaacgtatgacaacattgctaccggtagctaattcagtgattcaacatgtctgtttatcaaacacttgagagcactttcaaagagccctggtttgggtatgaggtagagttttgtgaggcttcttttaaagcctctctgtctgagaaggaatatgctacttttcataccaccttgccagaaaggaaggcccagaacagaaagaacacaaaagaggtataaggggttaagggaacctggaaaaacctttgaaaagtaaattatcagtttagaaatgctctttaaatgtcaacaaagagtcagcaggcagtgtgtcagctctgcacctggccacatttcctatcctctgttgcaacttagtgaagctacgtggccaaactagagccaacggaacataagtgggagtgatatatgtaatttgggggcattttccacataaaataaaagctctttgccatggaatccctttgtctttccccttcccatgtgtggtcacaggaatgactatgacccaccttccaatcatgcagatgaggataatgcccaaggggataaacttttggggaaaaaatgagtccactcaccaatccatatttaaagacttatatgtgtggaagaaataagcttttgtgtgttttttagtcactctccttcagtctctatactacagcagttgaaatagaccttacataatacacaccctttctaggtacctacaggtcttctgcaaaagcagccatacaatcttcagattgtgaccaagttgcttttaaaattctcatccaggttgcctcttttttctctctcttggttgtagcaattctcatcagtagtgctgccaaagttgaatcctctttcgagcacatgcaaaaaaaaaaaaaaaaacaaaaaaaaaacccacgaaactaggaaaagcattagaattgccccatgtgaattccactcacatttcaaagccaatacatgtaaaagattaaatgaaaatatcccatctactgttatcacactctgctgtcttcaccaatgtgaactgagaataagagatggcagcttttcaatgtattgcctagattcctctggcttgtagtgctcccgtcatttctatttcctaccatgcttctgtgataaagcgagaaataatatgccaaaatgccactagcattcaatacagggtatgctgtcctctacaattagcatatttttttctgatagaccaagtgtttaggatgcaatgatttataggtccaggaaatatatagacagttgcttggatgaaagaagggtatgtaggaagttgactttgtgtactaataaatgccaaaaggtacattaggttaaggaaattatgtatgaaggagtctggcgataaattactgttgcatttttctgagttgaattgcttatgtgtctgtataaattgctaagcagaaaataggctaagagcattaaaactttagttaactcttatttcctcaggtctatgtaattttaaacttatttaggacaatagcccatttgttttacaaatcacagtgttcattgcaatatctttcaagctgaaagcactaaatcactttatattatggagacctggaagaatgcagcattatagcttggctggcagaacatgtatcagtgagatattgatctaaccaggaaaaagaaaagctgtgctgaatggactccacactgcaaggagtgttatctgcaggctgcagtgtttgttcaaatcccatattgctggaggtgaggtcatatatatatatatatatattttttgcaggcttcatatgattttagtgacagttatggccattttcttaatctgaaagattaagaaagttgtttgttgaagaatgtctgtagataattccttgacatcaggagtagctcacctttctgcaggaatgggttaaaatggaatgttgatcaaatgctctgacttcttaagtatggtttgtctatacttccaaacctgtatcacagaacccctctggaccctttggcaattcaaagtatcaacactgagacaaaggtgtagctgtcagtcggaggggatattgtgtagttgccttaagtagtgttttcctagaagacccctcagaagtaaagaaactgaaacagaagtaagacatgagtcttaattggattatgctgagattaggatactgtgtggctctgacttctcatctcactttcaaagaccgaggagacaggtgcatccgtaatttgcatggggtccaggaaggagccctgtgggaaagactcagctctgtgtacagttagcattaggctgttccaatatgactgattgacatggactgactgacagaaaggattaaagtcctggaaagagaacaacagaagtcattgccaggagggaatgaaatactgtaaggaagttaggaatctgccatgctgaggataaggaaatagagagctgtgtttgaacccatcttcattttgtcccttaggaatgcatgtgctatctggaaggataaactagaataatcatatcaccagaaacataagtgagtcagctgttcgattcactcctactaccaagagtagacctctagaggagcagcatatgcatggcaactagacctctgctcctggcgtagatgtgggcccctggtcagttttcataagtgcttattaaaagaataatggaatggtcatcagcaagctcctgttagggatccacttactgtcctgctggtacctgtgcactctatgataattcatatttggaactgttttattccctttattgtatgcagagggtattttgtgtggtcagagattcttccatgtgcctgccaagtgattattcacctttttattccaatatcctatgtataattgcacctacacactcccatacaaatcctaatgcagtgtataggctgtgtattgctatttagtatgctttgtctccagttgtgtctctgagcccaggtccccctccataacatcacactgtgctatttctccaacatgctggcagacacagagctaacaggaagcctaaacagagcatttccctttgggttgagcgtgagggggcttcttcttcctctctcatgtcacactctgcttggcatgctctccagtcctctaaggaacagatgcaggagcacatttacaaagcaggactacgatgagcgggcacccgcgaggcttgagatgtgcccagcctcctccctaggcaggctgccaaagcaaagctccctcatgtaatagcttgggcagataatgggtagacacaggaggaacaaatcaggaagcaaactcactgtgggcctgattcccatttagagggtgagacatccacagtctgggatagtgagaaatttatggaatgggctcttttttccatttctactctcttctttgctgtggttcctcaaacaccacttggtgcacagagctagggaaaagcaacagagcttctgaaatggcatttggctaaaacacccagccaatcttctatttttatttaattttcatatcagcagtattttattaaaaccattagtaaaatacagagaatatctaattttagaatgacagcattcaaaccatccgttacaaattgattttaattaatgtggtttgtcataattaataggttattttgactctccacagtagccttcatagtggtagatgaggacctgaggtcctctctcccacagctttgcaactgccaggtgttacattacaatggaagtaagtcttagcttgaactcttctgtgctgctgtggaatgaattatcggtctcaattcatcccttcccagtagtattaagcacaacctagccatgcttcatagtgggtccacaatttccccactttttgatttggggttcagatgtgtaacttgctttggtcaatggggagtctgcagataattggaagtagaggcctgaaatgggctcatgaattggaattgctttctcagtttctgtcaccaccatgagaagaacgtatgccagatagctgctgccaattcattgaaatgagaccctcaaagtacaacgcgtaaatgcaagatcagctgaaattcagctagcccacaattccctaagtcatgggaaatatggtgtaggtcactgatatatcaagcttgttgcacgttattgtggtaatagttaattgacgtacatatataccaacacataccagcaagtaagcacacagaaaattatacaaccaattctttcaggcactccaccaagcacattgcagatgtgaaaatatgatcagggcaggattctgctcacctgattgaaattcagggatagatccctcccttagtagactgtccatatgtcaggtacacacagctgggataatacctttatcctagttgtgtaaaaccagaataaataatatggacttatagtttatctgatctaggccgaagtcttttaaagtaaattatagacaatatggcattatatatctgtctatcttatcatctactcatccttccatcattcatccatccatctatccatttatccatccatccatcatccatccattcatcatccatccactcatccacccatccatccatctatccacccattcatccacttatgaatccaggcactgttgctttccacagtcatgtgggaatgtaaacatgaccaattaaagctgagtcagtgcaatgtgattttaataataaataggagaaattattattgccccatgacctttaaacatttttgtcaaaacattgaaaatgctcttaccattagatatagagaaataaaaaaatagaaagactaatatttatttagtaaaatgtaatttaagatactagaaacattaagaatttaagtattttatttctttattaaaatcttatcaggagcggtttgaacagggcttggctttttctcatggttatgtaatctgtagtatggagggaatgagttttttaagccttggcaaattgccatactcctttcaaagactggatgagtttccaatatcttatccttttgagattttcatggtgtgaaatatccccaagagttttcttaatgtgaagatttttttgctgtcctccctcgctgcctctggaacattttttttcatccttcttgtcactaccactttccatatttatatcaataactttccctttactaagttcctctagctgcataatggaagctcccaaatggcagaagtgccaatatttccaaggtcacctagtgctcctataatttcatttacatttaattcaaattccacttccagatttattactctttgtttctttgttgttctttcatctttattgaccagttccctttttcaattgtccatttgataaatgagtttatccctgggggaaaagggggcaacacagctacacacttgccgtctactcatgaacaaatatatgcacagcaaccaatcgctgactgacttagaaagaagtgatgtgattggtcattggtcatgaatctgttatttacatagtgatttgttgactgaagagctagcaaagaagtttgtagcttatgtaattacttgcaattaaggtaatggagtaacttaaatttgaactgtgttgttgggtgactggtgttatttaattaaactgtgctcagtgaggactgaccatatttatttgtccctctctcactctgtgtgtgtgtgtgtgcatgtggttaaactatggatttctaagtcttttttcctataaaggtaatagcaatgctttatagctgctggatatggtcacttaaagaatttgctatcaaccccttagaatctgttatcaaccctttagaatctgtagtctctgtttccaaatcacaggctctgtaacttttctcattcttgtctttctgtgagtctccaatgtcaggagaactgcctctcctgtgagctttgtgccttcctgttgtgtctgtcatccttctccccagcatggggcaattggtgtccctctgggagttttcagatagtaatttgcccatcttggaaggaaatggtctccctttggcctccttacttttctcagggtgtctgttctcttcttgcaaatgtctagactcctaagactattgcctccacagcctggaacttttaatgctaatattgtataatctggtttgccagacctcatgcctggtttagaatgctcatcgggaagaaaaaggtgctcccaaattatgtggataatcttgaagttgaattattatttagaatacaaaatgtatacattgaaaagcaaactcatcttgtaaggaaaggaaacatttgcatttcatagtgagaacatggtttgtctaagcaagaaataaaattaaacatagtgagccaattaggaagaaatgatctgaatatgtatcattgtgacaatattaactcatgacaatttctgcttgtcccattcagtatcttttagacatttctaatctagagtcagtgcaaaagccactggccagcttctaaatgccagggttttaaatgcctgtcaaaaatgaatttgttaccttattttttacaaggacactttgtaatgcaaaagggcaaaataccatactctcccaggaaatatgtggtaaggaggctaaaccaatatttttctttttaagatagataacatccctcttcacaaagagaaaagagtaactgttgtctcctctaaactatctttcagacgtttaatgagagccatcttatcccagcgagtaaaaggcaaataccagctgcctcctgagagaggggcaaagaaaggtcaaggaagacctcctgctgctggctttgggggcatctgctgtttttctcacccacaaagggcagtctgtctttgagcacttacagtgtatgcaaggagagtagcccagttctgacctgtcaatcactaggttagactctctctgaaactctcctttaggcaatggcatctaatctatgcaacagtcagagtgccagacacccagggcttgggctaggcttgcagggctcgctggagtggcccttggatcttagaactaacagaatcaagggaagtgggaaagccaaggccagactcagcagcagtagtcctgtgaaagagctagactatggggagagaaaccaaataggagctaacaggtcagctgtggacagcaagagaaagagagaggttttggaatgaagggaagtgattacaatctaggaaggttactgaaaacccagggcttgtttttcaataccttttgttaggtcaatatagcctctcccaaattttaaaaggagttttgaagagggctaagctaatttgaacaagtgagatcaaacaactttggttccaactgggatcttctagtcatcttggcttcgtgtatgtgtgtgtgtgtgtgtgtgtgtgtgtgtgtgtgtgagagagagagagagagagtatgagtgtgtgcctggcaacggtgaaatcagtaagaggttaacaagttcttttgtttccccagttgaatttaggcatagtaagtaaacaaaccgacattttaacatgtgcttcagaaaacgggaaaggtaaaagtcacttccaaaaggcccaagaaatgtgcacatttatagcaaagcaagggtgagtggaatttgagtacataatatagagaagcaaacctatggtagtaccaaaaattccgccagtgatcattcctgggcttcaggacctgccatgatgccctggaaatgaggcagaaggaatcagcttgagctgcttttccgacttgatgaaggcattcctcctactgcaagtttctcacccccacttaagtacagaaggaagcaggatacaccaattgcttagagtatttccaaaggatttaatgcaagactgtattgaaatatgctttaacaacttctacaatttctgagactatgacaagtgatagttaattttgacattgctgactgtggctgccatttattcttagcacagttattcattgtactatctggaatacatgcctcctttttagttaaattagaatcatgataattaacaaatatttttcattgaaaaagtacattcacctaataagcaaagaaacataaaagaccaaaatgactactgctatgatgaaagacaggataatttttttatttgttctagacgtaccaaatagaagggaattacaccaactcaaacccagggcacatgtaaataaataaaagtataatacaaaatatctttcttaagatgtcagaagaaaatttagctattctgaaactcaacagcagaaactgttgtatttcccatactaggagtatcaataggcaagtgtcttagttcgagctgctatctcagaatattatgcattgggtagttgatgaacaatagaaatttatttctcacagttctggagagtggatccctgagatcagggtgcctacatggcctggttctggtgagggtcctcctccaggttgcagactgccaacttctagttgtgtcttcactgggcagaaagataaatgtctaaatcccttcctcttcttaaaaagacactaatcctatcatagggggtttacccacaaaagcttcgcctcttagtaccatctaattgggggttagagtttcaacatattaattttgaggggacacaaatatgcaatctataacagcaaggcattgagagtggagatttatatgagccaaagcagaatcacagacaaatcatcaacatggttgttggcacataggcatttgctaattgtttcctttatttaatttagcatttggaaatatataaatttatctacagaaataggattatggaggcatctaaaactcctctgttgtacttctatgccattcaacaaatacctgctctctgaaagccttcaaattgatgtctgcccttaagggagatgaatgggagaagataactagcagtgagcaaacactatatctgatcgtttacagatattaaataatttaatcgctagaaaaagaaagcaaagcatagataacatatataattatcccacttttagagatgcagttcagagaatttaagtgataaaattatctagtaataaacagcattgtcagtaatgttagtaataaaatctgaaaatactaccacttatcaaccacacaccacgcagaaggacctgggctaagcactagatgtatattttatcctctcagcatccctgggtgttggctactgttatttaaattgcataggtgagaatatgaatggttcctaagaactgtgcttctcaaaattttatctacatacaaataaactactgatcttgttaaaatgcagcttcagattcactaggtctaggtagaacctgaggttctctgtttttaacaagcttcagatgacacacatgctgctgatccatggatcaaacagaaaagctggggttgagaggtgaagtaactcggtcaagtacatgaggcagattctttttttttttttttgagacagagtcttgctctgttgcccagtctggagtgcagtggtgtgatcataattcactgcaacctcaaactcctgggctcaggtgattctccctcctcagcctcctgagtagctaggacaataggcatgcaccaccacacctggctaattttttttaattttatttttaatagagatgaggtcttgctatgttgcccaagctggcctgaaactgctgagctcaagccatcctgctgcctcaggctgccaaagtactggaattaaccagcatgagccaccatgcctggcccagattgactctcagtggagaaaagatcaaactgttatttgtttagttcaaaattgcaagtgcatcttgccaccctgtgctatctcttccttgggtttggcaattcagcttagtggggagaatgagatgtgcacaaggatgactatgagactcagtactaatggcaacacactctcagacagaggcaaagaattccaccaccgtctctgccactcagggcttcctggaatgcagaatatctatgagtaattccaaatggataaatgaggatgattcccaaaaagaggtgtctggtaagctaaacctagaagactgaagaagattttacacataaacacataagaatgtatatgtgcatgtatttatatatgttatattgtatacatatgcaatataaatctataatatacaaaatttatacatacacatgtatatgggtgtgtagctatatataatgtatgtatataaattatatgtatatatgaatatgtatgtgtatattcacacacacattatatatagacacacacatatacatatattttgatatctatcttttgcttctagatagagagaagtatgcacagattctatacagtatgaggcaggatcacaggacagcttggtattttgaatgtactttgattccacagatcatgtagatcacacagtattttctcttcccttctcttacatgaggggcacccggatataggacacttagagtagcttattgatttgcttctctacttgttagtaaaatttttaataataggggctatggaattcttgatcttagaatacctagggccctagatcttgtcaattcacaaaaataattcatttgaattatttgatgttcttatttcagttttatttgaattaaattgcttttgatatttgcctttagtaattcaacctcattttcttaagatttataaagtttttatttggcattaatttggaaaatcagatatcgtaattaatttaaagtcatagaaaataaaaatatgagagcacctagaagtttgtaagatgatgttctattgctttattggctttactcagttatttaaaacaaagtttatatgcaataaaattagtataaaatccaactgatattgagaaatatcaacagtaattaatcaaattaggtttctatgataaaacctcattattaaatttgattttatttatgttgacattttctaagaaacatctttagaaagaaagcatttgaaatcttctgattataaatatttagcctcttatgttatcataagaggcatatctattttaaagaagccactgagaagctgtacattaattaagaatactatttattaagaataaatagtcatagaaataagggtgctggtagttatgattccccaaatagaatgtcacttctgttaaccacaatattcagccatgaaccttctgaaatttcaggccaagaagaaaataaagtcatgtctatagctgtgcctagttagtaatcagaaggttgagtttgggggaaaaaacaagcttttctccttttctaaccaaagaagttgtttttatttggtgtttgtttatttattttcagctgttgctcaagcaggttcctcaggtacagactgacccacacagtataacaggccagatggtacgactttagaactttaagtcatatttactatgtgagaatttttttactcatttatttccttcttcatctttccagggacagcctgtgaattgtgcagtgaattctttcagtatcactaacctgaatctttttataatatcctcttttacctaaattttaaaagaaatcaataaaacttttagttattatttggcattcagaattagattcaaatacgtctatgtgggtgcctgtgcgtgtgtgagtgtgtgtacctgctggtaaagacactgaagacatcattccagcaaaaattgatcactgtgtttttggatttggtcccaagttattttctgtgagatcctctttctcatttttgcttttgattttgacagaaatgacagctgaaatgtatctcaataattgagtttttaactttttttaaaaagatagcttactcaaagcaactgttgttcatagctgttgtaatttaaaggaatctatgtgatctttgcaaaaataactttcctaggatgaggtcaagaatgagtaatgtacaaccacagaaaagacgtgacatgccttcttgtctgaaacacgtgaagacacaaggaagccttcatgctaggtaattatttccagaggagcttccatgggacttcataaaagcattgacttaatgatgaaatattgactctattttctcagtgaacactctattcatttgagcatcccatcattcaaaccttgtaaatcctttcacagtcttcgggaatagggtccagattgtcatccgcatcttgtcttcagcagcaaaaaaatacacactcctcccccactcagagaaactgccctttagccaacattttgtgtcatttaattatttgcaagattcattaattggcaacagcccttccagattttccttagaattaacaatattccactataatttatagattatgtgtcactcttcttcctcagcttgaaaagggcatacatatttcaaaatcacttttgaatcttgaaatttaaacattttccccaatgacatctattttaatgcacatgatttaaaacatgagcttttgatataaaataaagatagtttgaaagaaaaatagcagcctctaagttttcatatggttcttcctcctggggatatttctagaattgaaaacacttaagagggtgcagaattctttgtcgagtgcttgcttttgcttatttagaaatagagggacaatggcagagaggggtatgaactctcctttatcagacctgccttctgggctcatttctatatcttatcaataatatgactttggacatacaattccaaatctctaggtcgtagttttcccatctgtaaaatgggaaaaccctcaacctcaacaaattttttggggggttaaaagtgaactaatatatgaaaaacaattttgtatgccctgaattatttatggaattttgtaacttgaggtttgctgacctaagttgtgaggttaaaggtttagatattggaattatactaacttctaggctgaaagtgagctctgccattcatgctcaagactgtttgctttctgacattttaggtttttattctttccaagtatttatcacaattagggagaaggcattcaaaccttagtataaatggttaatctgaatacagactaggaagacttgggtcattcaaattcacaaacctgtgtaagactgcattgctcaccccttcgggatggtttttcttggtactcattggactgcaaagggtagcacggtactgtgccaccccaagacgaccttagtaagaagcctgggtaggatgcagctgttcaggggctagtgtctgctgggactatgaggttctaatttaacctcacctaatgtctcacttctattattatccaattttacagccagtccatgtgaggcacagccttgccaaagttacatgactaaatagagaagctgcgatttagaaccacattttctcactccaaatcttgctatctcaatcattatattgtaccttatttgctgaatgaatgattgaatgaatgaatgaaggatgaatgggtaataaatagagagacattttactacataaaagctttcctaagttatgggaaaatatttctgagatagttatttctgtatatttgctaagggattagtaattttcaaagttaggatgccacatgtcataactggagtctattacagttaatcttatggggtctgagttaatgcgctataatgaacatggttgtaaacagaaaggacacccatttttgcattaaatgccattagctggtctgagagcaccttgagattatgacatactcctcattttgccatttttttccctgtcagcatggagcacaggttctggtagagcgagagtgctttacaaagacttgctgaggatgagtggattaaatctttcactcatccaaccgcttaagtccctgctgcactgagttaggagctgggtctagagtggtgagagaatgatccacaatttctgttctgatgaatatttggaacaaatgaaggagtgctccaaaggaaattgggatggtgtgtggttgaggacaatgagggtactaaacaaagtgaaaaagacctcagaaaagtggtcgaacgaggcctctcttggcaagtcacatattatattagatatgtgaaggtgatgtttgaaggaagagagtgaattagaaggatgtgtgcataccaggggcaagcgcatctaagggagagcagcccttgcaaagaccctgtgctgagagtggcatgctttgcctgagaacctcaagaatggccatggtggctggaacaaagtgagtgaagggtagagtaggaagagatcacgtgttaatggcatgacagagattgttcatgaaagtaccttttctatctttggaatgatctcagtagtttgttttttttttttttgaaatggagtctcgctctgtagcccaggctggagtgtgcagtggcatgatcttggctcactgcaacctccccctcctgggttcaagtgattctcatgcctcaacctcctgatgcacacctgagtagcagggactacaggtgtgcatcaccccacctggctaatttttgtatttttagtagaaacggaattttgccatgtcggccagactggtctcaaacttctgacctcaggtgatccacccgcctcagcctcccaaagtgctgggattacaggcgtgagccacagcgcctagcctggagtgatctcattctttttgcttagaaagattattaaaatatttcgcaaatgattggaccctgagtagattggcaagttaacttacagaactaggtttgagaaagtttttctctcagatttgaattgatttgcttgaatcatttttttttctaattttgtccaaccattagctctggaatatggtacattaaaaacaatttgcattgctccattgctgctaatatcaaggtcaatattgtcaaaaggcatggagatagaaggtcaagatgatgcctcaaacagcatcagtaatttaggacagcctgtcacaagagttaaagtgattgataagcaggaagaagtatgaacaattcattataaaggggactggatgacttagatgttaagcctactttaattttctgcatagcaattatattgctgattcacatatgaaagtattaggagacttgggataattgcagctgaggacacatcttttccattgttcgtgggacataactaaattctctgataaattaatcatagaacttatgggaaataatttaaacagcaacaacaatgataatacctcatatctctacagcacattgttgccttcagagcactttcaggtaggccattagacaaaccagtgagggagaaaaagactggcctgggaaagttaaatgaccctggttccactgaaagttcatggaaatgcagatcttgtgttaatcatgtcttctccttcagtcacttctcaattctacctcaaaagctcagactcttaaaggtttcacaccttgccttgcattatgtgcttgaagcccagcaataacactggaacttgggtaatgcagatatcgattgcccaatttacagacaaagaaactgagttgcagggaggtaatgtgacttcagtcagagaaagtgatagaatactacattctgactcctgaggattttttttcttattaatattttgagtacataaaaattgtctaatcccatgagcttgggagcttgttgacttagaaactaggtcttttgtacattgagacaggtaccgttttcctctatccaaagacaaaattgaattattttctgttacgactattctctaggatgtaatttatttttagggacctttcatttccagacttccagaagattcaaattggaatcttcttatcatcattactattctttttattattttcatatccagggtgtctataaatcctcttattttttttcttgttctactttccccagtaaataaccttttgtaagaaccacccacccccgcccccaccattccagtgtctttttattttattttttttccagtgtcttttattttgatcctgcttcaattttagaagatcacaataagaaataacatggggagagcagacctaatagagattaggatccatcattagacataaatgagacacagaagagaacaattaaaattggaatcctacaggtatgaactgttaccatataatgtttttttaaaggtgttagcctttctcatccttaaattgccttcaacaggaattctctttttggaatatgtaaaccatgggtgggatacagaagtaacctactctaaatggaagggcaaagtggtgataagattgggtttttgaatcagataatcttgagttcaaacctcaactctatcacttatgaatttgtgattgtgtaaaagttaaggaacctctgtgtggtagttaactcttctgtcaaatgggaaaatgactttgtccctcataaagaaggtgtgaagagaataaagacacacaaaataatgccttactgtgcttagtttagcttacagatggatttatgtcaaccctagatgtgcgtgggtggacagctgatcactgttattttgcttttatgactactgtatactgaacgctcactctgccaggcaatctgaatggagctagacattcagtggagaatgaaagacattagatccctctcctcatgaagtttacatgttaaaatagaaaaatataggccgggtgtggtggctcatgcctataatcccagcactttgggaggccaaggcaggtggatcatgaggtcaggagttcaagaccagcctggccaacatggtgaaaccctgtctctactaaaaatacaaaaattagtcaggcatgatggtgcgtgcctctagtgccagctactcaggaggctgaggcaggagaattgcttgaggtgagctaagatcacaccactgcactccagcctgtgtgacagagcaagactacatcgagagagagagagagagagagagagagagagagagagacagaaagaaagaaagaaagaaagaaagaaagaaagaaagaaagaaagaaagaaagaaagaaaagaaaaagaaaagtaacaatttggaaatgtacttcgaaggaaactaataagatgttattacagaaaacagaaaggacaggtacttaaagtggtcagagaaggccttttgagaggatgccccaaaaagagtatacatcgtgtaatcaaatactgtggtcaagactgttcagcacagtgcatatcctgtgcaaaggctctgagatgtgatcaaaaccacttaaaactgatgtatcatcaaggagttcatgattcaattcaactctccttaagtaaaagatgaatgtacctttttcagacatgatattttaactagctcatgaaatagatcaatttagcacaagaagtatcttttcacatgaagttaaatggttaaatttataaagttattacatattacaaatctatactccaattcttgatgaacgtttcaagaacatgttgacttttctcaaggaaaatgacaaaactatacatttcatatatatattatatatatatatatattcttatttatttatttatttattcttctgtgattttcctcagtggcatttgctaatcatctagtccaggaaagctcttgggaaaactatttatgtaaggtagataccatgataataataacgcaagagagaggaagtcacatagactaagagtggttctgtatttccaaggaggaatacattatttattgctgagaatttatgaaaaattttgcagaataggaaatctataagtcctaattctataaacatgatgaggaaacttttccacatgtggaatttcattttaataagtgactatatataatgccatatatcagcattatgcttagactggcacagagggtgtctgaagggaaatgatagatggggaaacctaggtggccccatgtaataggggatctgtattttaagaagtttaggcctttttattttatggcagggagaattcagtccaaaaactatggaaggtttacggttagaatgaaaattttctgagcaagttatcaagactatctaccaattacttcaataattaggcctaaagtaaagcatttctgaattagataagtcatttttatttgtacagaagaacacttcattaatatatttcaaaccaatggcaggtttacaagttatttaatagtggcatataagcataaagcagttggaagaaaccaatagtgatttggataatgcttgtgtatatattttcaaacttatttataaataataaattagcactccattaagaacacatgagatcatgatttggggagtggaaagggagggaacccatgcccggataaacaaagagtctaatgaatctaatgagtctgagctgggtagaaaatattaatagtagtcaacattctttcatgaaggacgtgggataaaaatgtgtccattatttgtgctggatgctgagtggtctggatggctcattgtcagaaaaaacaactttcttcactgcttttttgttctagtaactcttgctgtataatacgttagcccaaaacttagtggtgtgaaacaactgttttattttgctcatgatttttggcttatgaattataaaagaacccaggtggacagttctctcttgggatccctcacactgttgcagtcaaacattttctgggctgtggttgattggcctgctcatataagatggtttactcaggtggctggcagttgatgctggctgtcagctggaaactcagctggtgttgtcagccaaagcatctacatgtggctttgtcagctttgtattcttaaaataatcagacttcttatgtggcaactggcttcccaccctgagcaagcgccccaagagaccagagggtagctgagcctgcatggtcttctgtgacccagccttagtagtcacccagggtcaattccttcataccgtattgttgaaagcagttagtctacccaggcccaaagagaagaaacatagagtccaactccttgtaaaaagagaattaaggtttttgtttggtaaagatgatgactgctacagatttcttaatgatttgtggtcattaagaaatctatggctgggcgtggtggctcacgcctgtaattccagcacttttggaggccgaggtggatcttatcttatgtattattatattctaaacataatataatggggaccatttcttaatgaaggcattgataatgaagacctcaaaaatacatggagggatgccacgacatagttgaactctgatacattatgtaaatgaaagaaaccattcagaaaaggccacatactgtatgagtccatatatacatatatatatatatgtatatatatataaataaaatgtccagaatacacagaaaccacagagacagaaaatagattagtggtggctaaggggtggagggaaggggaaaatggggaatgactgataataggtatgggatttgggggagaagagtgatgagaggttgatggttgtacaaccttctgaatattgtacaaccttctgaatattgtaaaaccagtgaattgtataatttaaaagggcaaatgtttgtgatatccaaatgtatcttttcttttcttgtatctcaagaaaagaagaagttcacagatgaatttctaaaatctcaaaatactgtgttatcaattccaaaattaatattcttgcatacgttagcactctggaattagtctcatgatagctgtgtgattgttttctctctcagtagtacacaaagtgatgttgtatcataaaattcactacattttaaagttgataaaatatggtatatttctgattttacttatcaccagatacaaaggtaactattgcaaatctgtatttcaaagaatttacactggacaaattgttggatagatttgcctcaggctcctgagcagctgggattataggcaccaccaccatccctgactaatttttgtatttttagtacggacaggatttcagcatgtaagccaggctggtctcgaactcctgacctcaggtgatctacctgcttcagcttcccaaagtgctgggattacaggggattacaaagtgctgggccgctcctggcccagtgttttttacttgatatttataaggaggaaaggaaggaagaaagaggagaaaaagaaggaggaaagatgagggaaagataggacaggtggaaggaaagactgattttaccaaatgacgtttgtttgtttttgtctaccttaattcaaaacaagctcttgctgggaggaatggaggctgaggaagccatgaccaaaagtataattagtatcactgcaacgagctggggtaacctcaggcatgtctcagagcctctgtcgtcctcaaacatcaaatgaaggcatcaacaattgcaaacgttcaaatctactgatatttcctccactccttagttgttctttgtctagaaaactccagcctaatctttggactctgaacactcatcagaaaactatgatgtctctcttaagctctcagacatttgagtatttactctgagttctaagtgaataactgtttgagaatgagtccttcactaaattgtaagatgctccggggtcagaaaaaggctattatcttcacaactgtggcttctgacaattgtttggccaagtgctcagttagtatgaatggagggaattaaggtggggccttagcgcaccagaaattccatatcttaggttttaggtaacagaggcctaaattctggcagagcagtaatagaaagaaagttaaacatgtggctgagagaaatcaagagagatgggaaaaagaaagcgagataaactgagtccttattataggaaaaagttgattctattaatccaagcaaagtcaagaagaagaatgagtctggagtataattctctggagtggcataggagccattagcatgattttacgtttcatgtggataaccattttaaaaatgtcagtagttgtgtcttaatgtgttatagtaagaaaaaaaactaacacatcaaatttgtgatattacagttaatgtttcctaagagtgggcaaataatgacagggaattgttttaattcagttgaaagaattataatgataggtaaatgtaggtatacattgggaacgttgtggtttcagtttccagaggtttgagaccactgcaataaagaaaatggtgcaataaagcaagtgactagaaatgtttgttttcccagtgcatatacaagttatgtttacactatactgtagtctataaaatatgcaatagcatcatgtcaaaaaatgtacatatcctaattaaaaaacactttattgattaaaaaaaggtaacaatcatgtgagccttcagtgagttataatccttttgctggtggggagtcctacctcaatgttgatggctgctgactgatcagggtggtggttgctgaaggttagggtggctttgtcagtttcttaaaataagacaacaatgaagtttactgtatcatttgactcttcctttcacaaaatatttctctgtagcatgtgatgttgcttaatagcattttacctacagcagaactgctttcaaaattggagtcaatcctctcaactactgccactactttatcaaataagtttgtgcaatattctaaatcctgtgttgtcacttcaacaatgttcacagcatcttcaacaggtgtagatttcatctaacaaacaaacaaaaaaacactttcttagctcttccctaagaaacaatgcattatttgttcaactttttcatgagattgcagcaattcaatcatgtcttcctgctgtacttctaattctagttctcttgccattttcactacatctgcagttacttcctccactgaagtcttgaacccctcaaaatcatccatgagagttggaatcaacttctttccaacctttgttattgttgatattttgactatagatccttaatagtcttaatggcatctaaaatggtgaatactttccagaaggttttcaatttacattgcccagatccatcagaggaatcactatctatggcacctagggccttatgaaacgtatttcttagataataaaatttgaaagttgaaattactttttgatccatgggctgtggaatggatgttgtattagcaggcatgaaatcaacattaatcttggagctctggggtgaccaggtgcaattgtcaatgaacagtaatattttaaaaagaatctttctttgtgtgagcagtaggtctcaatagtgggcttaaaattagtaaaccatgctgtaaacagatatgctgccatccaggctttgccattctatttatagagcacaggaagagtagatttaacataattcttaatgaccttacagtttccggaatgataaatgaaccttggcttcaacttaaagtaaccagctgcattatgtaacaagagagtcagcggttcctttgaaattttaaagccagtcattgacttctctctagctatgagggttttagatggcatcccttccattaaaaagctgtttcatccatattgaaaacctgttgtttattgtagccaccttcatcaattatcttagctagatcttcttgattacttgctgttccttctacatcaacatttgctgtttcacatgtacttttattttatggagatggcttctttccttaaacctcgtgaagcaacctctgctggttcccaacttttcttctgcagcctcctcacctctctcggccttcatagaattgaagagagttaaggctttcttgtggataaagctttggtttagggtaatgttgtggctcgtttgatcttctattcagaccactaaaactttctccatattagcaataaggcttttttgctttcttattatctgtgtgttcattggagtagcacttttaattttcctcaggaacttttcctttgcattcacaacttggctcaatgtttagcacaaggagcctggatttccacctgtctcagcttttgacatgcctccctcactaagcttaatcatttccagcattaggttaaaagtgagagagaatgtgactcttccttttgcttgctcacacagaggcggttgtaagtttattaattggcctaattttaatattgtgtgtcaggaaataggtagactgagaagagggagagagaaagggaatggctggttggtgaagcagtcagaacacacataacatttattgattaatgtcactgtcttatatgggcatggtttgtgctgcaccaagacatttacggtagtaacctcttaaagatcaggattacagatcatcataacagatataaaaatcatgaaaaagtttgagatattaagagagttaatgaaagacacacaaagacaggaagtgagcacatgccgttggtaaaatggcactgatataaacttcctcgatgcagggttgtcacaaacctttaatttgtaaaaaactcagtatctgcaaattgcaatcaagtgaagcacaataaaataagctatacctttagggtccaatctgtggagaaaggaatgaataaatatggttatatcaatcagggttcccccaagagacaaaaccaacagaagatatatgtgtgtgagcacacagagagagagagatgattgattttgattttaaggaattgactcatataattgagtgttggcaagttcaaagcctgtaggcagaccagcaggctgaaaacaggaaggattcttgtattacagtcttgaggaagaactccttctttctgaaaaccctcagtttttgctcttaaggccttcaactgatcggatgaggctcactcatcacccattatcaaggataatctcttttatttaaatcaactgatcataaatattaatcaactctataaaataccttattagcaacatcaaaactactatttcaccaaacaactgagcaccatcatttagccaaattgacattaaaattaaccattccagagggaaacatttggtgaggtcagatttacaaataatgagttgcagatactgctggattatatgggtaaaaatgctcagtgaagtcttagaaatgaaagcaattcatgagcaatcaatctgccttcactttttcacctatttttattcagaaagtcacttagtctggaaaatgtcgttcatatggttgcatgccctattgttaagtgaatgagtgtttcaagggctttcctgttaggtttatttcatttagctctgttgcagcattacgatgtaagtgcttaccacaaaggtttgctaatgagtgcccttaatttgtattcagatgggagcaaagagaaggaaaaatacacaagaaggagtcttgtaattatgctacataaaattattaggcaatttagaaaattgtcagtgggaaactgcccatcatgcataaaaataattttgattttgatgtacagagtttaatgtaagagtgattgtagggagaccatgttattaatttttcccttaattatccaagcacacttgaatttattttaaggaaagtgatactttataaagttgagtcacgctactccagagaatacttgttttcgttctgtgacaaagtttattttgcagggcttgctgtgaactgtataattggtaggacgtgaaagaaccattaattatgtccttccccttcccctaatcataaataacaaaatgatgctatattttctggcaaactaaagtatatgtgatgtaaagatgttcaggtaatttgtgggcttatctattgtcttaaatatagaactacttttcactcatttttggcatacacagttgtgtattcagataattgtcagtgcaatgctaaatgtgttatgttaaaaaatgatgaacatattacctctcagttcttgttatagataatttcttgcaaattttaagctagagatagtcaatatttaatcagagaacatcttcccaggattcaaagtataccacatcagctgttgaatgcagttaatttgcattaatgtgttacaaatcaatgttctgtagtattttaggaactgtaaaacatacctttcaagacaaagtccaaactctttagtatgcaatatgtagttaacctattctggaatgtctcttctaactgagagccaccctgtagggaattaccttagtcttttaattcctgtttgtatcaggtgacttagcaaccacctgcatagcaggaagacggcaccaaggaatatattcatccccttacatagtttgaactatgtgaccaagaaattacagtccatttgtatagagtgccaagctctgaaggctggaagacatgtaagttcatgtataagcataagaaggttgtccatagaatgaaaagagaggaggagagagttaagggccatctgggctcccagagaaagtgagctcaggtcccctttgggccctaaggatgaaacaactgccctttgcctggattcacttgactgggttctttgctgtcattggtagacacatagagccctcctgtctgctttagtcttgttctaccttctcagcctcatatagcaatacctcttatattctgcccccacccaccctgaccatctcagtgatttttgaataaatcttgtctttcactcgcctctgcctttgcgtagaggatacctgctgtgcaaaggtgatgtgagaaagtcaggtctaaattcacctccagactctgcctttggtgggctgtgtaatattatgcacatcacttcaatccttagatttctcatgtctagtatggaggaaatagtacttaacatggagacttttcaggaaaattaagtgaggtattatccacacagccctcataatggtgcccaacactgtggttatcaatagattttagtaccatttttgccagaaagttgaggcagattctaatccaacttttaatatccagatctatccattattccctgattcagtccccaaggtcactcattctttcccttcagctccacaaaaaatccacttacaaatattttatacactaaatcacatcataatcattatggatttctccaaaattaaagtaacaactttttctggttctctgaaaatatgaataaaagaggctgataatgctgcatgcccagaggtgaacatggttcaataagagagagagaccttgtggaagtgatgctggaattgaaatccaaggattgagtagtggcaatggaagaagagaatagtattccaggcaaaatacatggatatagattccaggggaattatgtatgaagaaggagcatagtgaaacttaggccctgcaaggccagtgcagcagagataagcctgtttccttgggtaatggtagggactgtagggcacagtgaacagtgtttatgtcattctataaataatactgataggaccacttattgagtacttcttacatgccagaagttctttggtgctttcattacattaacttatgctattgtccacagtattctaaggtggttgctattagatttccaattttacagaaggggaaactgaggcacggggcggtgaagtaactcccagaatgttcacagtcagcgaaatggtggattctgaatacaaatgaacacaatgaggctccaggtttcctgcttattatcaccgcgaagcccagcctcagcgagcaagggaaggagctagagagcgggctcccaggcacatctgcatgtgtgcactggccttgtaacatcagtctggctcttaagagctgatcagaaagaggacagaaggggagctggcacactggttaggtgaaatgagaaagctcaatgagtgatgatggtaattcagactagaatagttagtgttattttgtgaaaggaaatttcaatttaaccagagcaccttgaagtgaaggctttgaattggaaagaaggttttaaattgctatcagaatttgccattttagtgattgaaacattttagggccaaatgtgccatgctgcacctttccagaaggaactatttgagggaaataactgtcagctcctatagtaccagtgtttaaaatgtaagtttagggagaaaggcagttcaccttctctccaggtggggactgactgaggtgttgaacaaccagatttggggatggtattttttgaatttaattaactgctacatgtgaactagtaagatcaaatcacccacaaggtagatatttgagaaactcagtgtaaatgtggaaaagttgatgttatgttccaaagatgtaataaaaaattaaccagtttatgcaaatgtttatgcaaattaaccagtttatgcaaatgtttatgcaaattaaccagtttatgcaaatgaaaagaggaggtaagaaggtataagatgctatgtttgcatcattcactgggaacatttgaactttgcagattaatgtccttggtggaagaagttatgacattatgttatttgttggggaaaaaccctccagtgtaaagacttttatttatttatttattaaaggcaggatctcactctgttgcctaggctggagtgcagcagtttgatcatagcttactgtagcctcaaattccagggctcaagcaatcctgcctcctcagcctcctgagtagctagtacaatacatgccaccatgccctgctaatatttttttcttttttttttggagacagagtctccctatgttgcctaagctggtctcaaactcctggtcttaggcaatcctcgcacctcaggctccctcagcactggattacagaatacttaaaaataacataaatcagtcagatatttaagcctcacaaacttttcctgaagatttactgagctacttcttcagatgaaaaagacattttgtaataaatggtttctgaaaaaccaaaccctcaaaattgtaactgggatggatatgattagtgaaacacattaaacttaaccctacagggataaaccaagagcgctactgatgtttataaggaaatacaagcattacatcttaaactagacaagtttccactgctgagctaccctgagcttagtgaaattaactattttcacaaaatggaaatccattaatggaaatgacatcataaattcagaaaagattcttagattttaatatacttttcctaatttaaggcaaattgagccaccaagaattgaaagagaacatatttggataattgaaaggcagagtttaaacattccggaaataactatctgcactttcaaatgcaaggtcttgcttaggtttggaacaacacaggttttcttgatcacttgtctaaaacagtaactgagagccacacaacacaacctcgttttataaaggttgtctctgatacttagaaaaatctaaatgtttctgtacttttgcaagttactaaagtctttccattaaattatttgacttttttttctcccgcccaaaaagtgattagcgcacaacaaaatgtgtgtgatttgttaatggagtattctttcattgcagatttatatgttcttaaaacagtgcaagccttttgtggaaataatgtattttgaaatcatatattcttatatacatgtctctaaaagttcatcaaataaaacgtaggaatagacatttttacaaacagaaaacagtcatgtggttctgctatccaaacacagtgacatgatcttttagagtttattttcagtcttttacatattgaccctgtttttcctccatatttgtattcttttaggtttgtttacagagttgtaatagagcatttgtgtgaagcagtttatatggtaagtgacagaaattcagctcagagacactaatatactcacaggatgtattggtctatattgttcctctaggaaggtgtgatccagaaactcaagagaagtcatcaaggactcagtctctctacatatttttcttcctttataagtaaatggcctgcaaatcttttctcatttctgccgctctccctgaaggacctggtagagtacttccttttgaaatatctggctgcagttggcctatagctcagtctgggtttctggcttgttctgtgcatttgtttttcgtgcttcaattagccattgtgtcctggtaatggaaggaaacaatcctcagagatcttgtcacactaagtctgtggcacaatttgaaacattcagtaataccagctgttctaagcagaacagaagtcataattagggatgcaatgatttcacactaaactgtagttacagaatatataactacattttaatgctcatcaatttttatcttatactgtatttatcttcaaagaacaaatgaaccaagtgaattggatttcagatacacagagctggatttatctaatattccctttctcatcttctgctgtaaaaaaattatttcttcttatgtaaactacctaagaagtatcttttcctcccagaatactgtagctttgtctgctcaaatccaaattatataaaatggcaaagctgctctggaacacattttggctgtttaatacacagttaaacatacaatttccatgtgacctcatcatcccacatccaggaaattatcctaaagaaataaaattgatgttcatgtataaacctgcttaataattttttagaaaagtaccattgccaagaactggaaacaacccaaatttccttcagtgggagaatggacaaaaactatggtatatgcataaaatggacaataaaaagggaaaaattattgatatgtgcaatctggataaatctgtagaggcatcagtataagtgactgtagctagattaaatactttgtaattccatttatgacattctgaaaatgtaaaagtatagggacagattggagattgccagggattggcagtgacagaagggtgtgttaattacaggggcagcatgaggcatttctttatggtgctgggatcatcagtatctgtttgtgctggtggttgcaagaatcttcatatgggctaaaactcatacaactgtatagcaataatgtgaatattactgactgttaaataagatatctatgagtgaaccttcactaggcaaataaaataaataagtattaacacctgtgactcatatctgttgtcattttccaaagcttgaagcccagcataacatcatgcttggttttccaattcatcatgcttttgatctttgtatgacacatgcagaatttgggaaacatcttgggagataatgagtttttagtaatttgggagataatgagtgctatgttgggataagttaacacttgttttgttaaatattacatggaagggaatagagaaaaagtctatgcggcaacaatgatgtactcttagcatgacacatggaagcttatgaaaaattattaaagactttgcactcagttaccaaaaaaaaagtctattatgtaagagatctggatcacccccagcagatgtagggctgaattgttggttgctgttcatctgtaaaaaatgaatttcccaaatgcttctctagtgcttattcagctctgcttagagaagttttatccttgcatttatttttttcttttcgtggccatagtgagaatggtattaagaactgggctaagccccagttctgcatctgcttgctcctttaaattagtgagagcaagctcattctagttcagttcctgagtagctgtaattaatggtttgtagtattcacatggcttttgaaaaggacccctttctctctttaaagcacctttaaactttctagaaaaaaaccatgtaatactgccttgaaaacagtcccttctgggtgtcatttcaactactttcggttcaacttcaagttgtccagggaaaataaacccatcaagtagtgcctgcattgttagcttgagaaccagaaggaacttcgaccacatttgcttttgagaatgtaataatttacatgtgatatatgatcgtttagttaagcaacagtgatacagaggagcttcaccttggcctcatccattgattgtgcagatttcaatacacttgtttaagctttgtggatgtggttgttcattcaatcaacagaagtttacttttgcctatcctggaccagaaatcagacataagctcaggatattaaaagatgcttatatgtgtgtttggggaaagggataagaaaatgtagagaaaacagagaaaagtacatgttgtgagatatgtttgataaaatctgggttgatcaaatttaaacaagattccagaatttgtaatgtattaatatgcacaatgacctttcaagaatggaatctaatgtgcaatgattctcaaatctctctgactgggaaagcccctgttaatttttctcagagaactttataattgtagtatccttttctacacactttgcaaaatgtatggatgttagcaaaaaaaaattatcttttatgtattgattattatcagcaatgcttcttactgcctcagagccagagaaattgcaagcagtgcctgaagtgttgtttgccaagcttctggtaacatacaacattgttttttgttttgttttgttttgaattactgtttatcaaatagaaatttagctatgtcagtggtcagaattgtggaaatagtatacatacaaacttgttttgttttgggaagaactagatgattaaggcagctttgctatgtggtaaattatattttatgcctgggtaacagttgtcaactaaaaatgggagatttgctgtcagaacttgttgagagtggcatgctcagtgtataagtaggtttcctgccataactacattgagtatatgcattatataaatgatatatgagtttttagtaatttgaagagaaatgtaatacctaaatacattttcctttctgttacttaccccatatagttttgcaacatttagtgccaagctaaggtgacttttgattattgaattaacttcttaattccaaagagtttgtgcacatcaatagaattttgttcaaataaattagactatagactaaaaacaatttctagaaaaacatgttggcttgccacttaagattatttctctgatgtctaaaacaaattgaaacttagtttcaatgtagcattgtatttaatataatcataatttcaactgttttaggaaaatattttattaataaaccaccatagtccatcaaacagataatctgtattatactagcatgttagcttaaaatgattttgtatatattatcgttataattatatatatctaatgattgaagaaagagaactgatccactacattgttgttgaaagtgaatttagaatgagttatatgttaatgcaatcttgctatctttggctgattctggaaggagttgaaaccttaattgatcaatcacttgattcagctgaaacttagagtgaagatttaaagtgttcttaatttgatcaaaatggcaatttttttttctgaatccaatatgtggagggaaacacaaggaaacagtaattaccattatgaaagtttcatgaaattatggtgacacttttaagtctattttttaaagagctttattgagaaacaattcacatactatgtaatcccccttttaaagtgggtcatttaaaggtgttgatattcacatagcagtgcaatcaccgccactatttaattttagcatattttcatcactcagaaagaaacctcataccattagctgttagtctacattcgcccattttccataacctgacaaccactaatctacgtatgtatttgtctagtatggacatttcatacaaattgaatcctacaacatgtgatcatttgtccctggcttctttaaattaacaaaattctttcaaagtttatccgtgttgtagcatgaagtacttcagccttttatgagtgaataatattccattgtatgggtatatcagattttctttattcattcatcagctgatggacatttggcttgtatctacattttagctatggtgactaatgcttctatagacatttgcccaaaagtttttgtatggacatattttttcacttcttttgagcatgtaccctagggatggaattgctggatcacatggtaattctgcatttaacatcttcagtaactgccaaactgttttctgttttgcaaagtggctctagcattttaaatcccaccagcaaaaatgtgaggggaccaatttctctatatcttcatccacagttattattgtctgccttttttgatattaatcatcctattggatgtgaagtggcacctcattgaggttttgatgtgcatttcttgatgaatgataatgagcactttttgtatgcttattggccatttatgcatttttggagtaatatttttcaaattattttcctatttaaaaattgggtgatttgtgtttttatcattattatatgacattttcatatgttcaggatacaaatcccttttgaggcatatgacatccaaatatttatccattttgtgaattatcttttcattttataaaattgtatcctttaaagtgcaaaagagttaattttgacaaagttaaatttacacatttcttttttattgttgctgaccttttgttgttatttctagtaaactatcacctaactcgaggacacaaagatttactcctatgcttcttttaaaatttttatagttttagctcttacatttaggtctatgatctattttgagttaactcttcatatggtatgaggtcaggttccaaatttattcttttggatgtgggtatctagttgtctcagcagtttatttaaaaaaaaattctttcctccactgaattgtcttagcacccatatagaaaatcaattgaccataaatgcaaagatttatttctagactctcaaatctattccattgatctatatgtatattgaaatacaaattccataggtcttgattgctgtgttgattactgcaagtttgtaacaagtattgaaattatgaagtgtgggtcctctgctttgttctttctcaagattgtttggttattctggaatcttgaaattctctacgaacttaggattaacttttcaattttggcaaaaaggccagctggggttacagtagggatcacattgaatctgctcatcaacttggggactatagatattataacaatattaagtcttctgattcattacattgggtctcatttcaaatatttaggctttcttaattttttcaacaatgtttgttgcataatggaagacttgtattgtttttcttaagtttgtttttaagtattttatttgtaatgctattttaaatggaggttttttttttagagtttccatttctctgcttgcattacccatctgcttttgtatgttgtccttttcttttccccattagaactcttagcaaattaatcatagttattttaaatttctgttctgctaattccaaaatgtgtattatatctaagtcttgttttaacgcatgctttgtctcttcaggctgtgttttttatttgtttatttgttttcttttggtgtgacttgtaattattttgttgaaagccacacacggtgtattggataataagaactgagaacattagtctttgattgagattttatgttcatttgccaagcaaatgtgtttactgtttgttgtagttatgatttcagacactaaatttttatctaatgttgtgtttgagtcttgcctgttgtctttgggttctcctagagactccttcttaaatagttcattagccttgtagttttttgttctagcctgttattatagaagagtcctattgatgtggtgataagctgccgtgagaggggaagcattttacaaacctgtgattagatctgaaccttttagtgaacatgtgtccctgagatgtgaccatcacaaataattcttggctttccaccttcctctaaggtaaaacgggttttgctagagtctaaccaacctcagacaaaggaaatacccaactccagcccactctagcctttcggctcaggtagtattatttccattgagggcagacctttcttaagaacagagcactctgggtatatttcaaaatacaacaccagaggtttttctcccatcttcactctgagacccctggtgggactcctgaaggtaaaagttatgaaagtgtgtgagggctcccgctaaagctgggacaagaggaattttaatttctcattatagtccacgctcagtctccagtagtgagtaagttcatttttaatgatttatgactgttgttgtctccaatagtggcttccgttgttccttgtaagctctatgtattcaaatgtgtctctagttttgtataatggttgtttgccctgtgacctaaattctctgatatatctaagaaaagttatctattttcaggtttttttttttttagcttctttcttgttgtgaggacaggaaatggatgacagctttcaagctttttaccttttggactgaaagttgaaagtcctcaatggaattattattattattattattattattattattattattattattattattttgagacagggtctcactttattaccccagctggagagcagtggatgtgatcttggcccactgcagcctttgcctcctgggcttaagtgattctccagcctcagcctcctgaatagctgggactacagacatgcaccaccacgcccagctaatttttgtaatttttaattttcttttcttttggtaaagatggagtttcaccatgttttccagactggtctcgaactcctgggttcaagcaattcatccacctcagcctcccacagtgctgggattacaggcataagccactgtgcccagcctggaattcttttcttaatttcattttcagattgttcattgctagtgtatagaaatatgactgatttttgtatataggcctcatatcgtgcaatcatactgaacttttaaattcgttccagtagggtatgtgtgggtgtgcatttgtgtgttttggtatttttgcaagataatatcatcttcaaatagagatggttttactttttcattttcaatcttgtcttttatttctttcttaactgattgtcctagctagaacctatactgcaatgttgaatataagaagcaagaacaggtatgttgtctgttttttattttagggggaaagcgctctatcttgcatcattcattataatggtgttggtttttcataaacgctccttatgagtgtgtgaaagttcttttttattcctagttttctgacagtctttcttatgaaagaatgtgagactttttgccaaatgctttttctactatcatggagattataagttatttatatttgtcctttagtctattgatatgatgtattacatcgattaatttttggatattaagacaaccataaatttatacaataagtaaaaaatgtttatgttgtacaatcctagttatatgttgctagatttggtttcttactattttgttgagttgtattttgtatgtctatgttcagaaggaatattggttcgtagctttgtgttcatgtttgttttgcttttccttgtgaggtctttcttgcttggttatgtatcagaataacactggtctcactttgagtcaataagtgattcttcctcttcctttattttttggaagatttacaaaggactggtattaattcatctttaaacatttggtagattttatcagtgatgtcatctgggcttggtcttttattgtaggaggttttaaaattactaaactgattttatttatttgctatatatattcagatattttatttcttcttaagtcagattttatagtttgtacccttttaagaatttgtccatttcattaagattatttaatttgctaacaacagttgttcatagcattccttattcttcttattttcctctaagtttggaagtgatatctcctctttcatttctggctagcaatttgaacttctgtattcatggttagtctagttaaaaatttttcaatttggtcgatctttttaatgagctaaagttttgttttgttgagtttctctatatttttagttctctactattttttccaatctaatctttattattttcttttcttctgcttatttagtttgctcttatttctccactttcttaaggtatatgtttaggttttgatttgagatatttcttcttttttaatataggcatttgtgcctattaatactttactaagcacagcaatagctgaatttcataattgttggtacgttgttttttctgttaattgatctgaaatgatttcctaattccccttgtgaatttttttcctttgactcctttgttatttaacagtgtgggttttgtttgttgtttgtttgttttttacttacatatatttgtgaatttcctaaatgtcctttagttaatgatttctaaaatttcatttcattgtgttcagaaaatatactttgtatgatttcaatatttttaaatgcataaatgtttgatttatgtcctaatatgcaatctatcctggataatgttctgtgtgaactggaaaataatgtttgatgtttttaggtggagtgttttatagatgtctgtttaagtctggatagtttctagttttgttcaagtcctctatttctgtattgatcttcctcttagttgttttattcattattgaaagaaggtgatcaaaatatccaactattagggctgaattgtctatttctcccttcaattctatcattttcccacatatatttcagtctatgttgttaggtgtatatatgtttatattaataattaacgtatattactgatacattaaaaatttatcattataaatttcatccttttcctgagtaataatatttgtcttaaagtctctttcgcctgatagtatgttttgagttatttgcttagtttttgtccaggggattgcaatttacatgttaatttataacaatctaattggattagtagcaaattaatgtcaaagcttaaactcctctttgttctattattgacatacaaattcattttttacattataagtcaatcaacacagttttatccttattgcttgatacagttgtttttaaatcagataggaaaagaaaatccttacaaaacaagtatatttatattatctgttatatttacctatgtactttaactagtgcttttatttcttcttgtggatttgacttcctgtccagtattccccctttttatttaggttgtaattttttcttaacatttgaatgataaaatgaataaatatagactttttagttggtagtctttttcttttggtgctttgaatatgtcatcccattgccttctggactccatggtttctaatgaatagttagctgttcatcttattgaagactccttgtgtactgtaaattttgtgtttttttctctttgcattcagtctttgacctttgacagtttgactatgatgtatttgtgtgtgaatttctttgaatttatccaaatcagagttttttgaacttccaaaaatgtagattagaatttttcatccaatttttaaattttcagttgaaattctttaaatattttttccgctatattctctgttttctttttcttggcctctcatccatcatgcacatattagtaagcttcatagtgtcccgtacgtctctgagtttctgttcatttttctttatttgtttttctttctattctcagactggataataatcaatggatctatctttaagttcaccggttcattattctgacagttgaaatctgctgccaacaccttcttgtgaatttttatttcaataattgtactgtttttgaccaaacttcaatttagtactttttttgttgttgttaccatgtcattctgctgaatctatttagtacttttttatagttgctaatcctttattaataatctcagtttggagaaatcagtcccagactttgctttatttctttggatgtggtttcttttacttctttaaacatatttataataggtcattcaatgtctttttctagtaagtccatcatctagtccttctcagaaacaattttagttgactatttttccacatatgtttaggccatactttcttgtctcattgagtaccagtttttttgttttttgtttttttttgagatggagtctcgctctgtcacccaggctggagtgcagtggcgccatctcggctcactgtaagctctgcctcctgggttcacgccattctcctgcctcagcctcccacatagctgggactacaggcacccaccaccatgcctggctaattttttctatttttagtagagatggggtttcaccatgttagccaggatggtctcgatctcctgacctcatgatccacctgccttggccacccaaagttctgggattacaagtgtgagccaccacgcccgaccattgactaccaatttttaactgcacattttaaataaaataatatgccaacattgtaaatcaaatacccctccccttttgcttttgttatttctacttcttggttttgtttttgttgttgtttgcttttagtttctttcatggactaattttgtatagtttgtgtttttggtcatgagtaactactaaagtatttactgggatggtttggtgtcagctaatggttggaatattgatttccttcaatcacttcaatcaatatgtttccgaccatctgccaatgggctctctacttgtgctggggatgacttcaatctttggctgtttacaactctgttttaaccttaacttttatttatggaaaggctcaacaacagtcagtgtgagatgttatgacattttcaagtcttttctaggtatgcacacagacttttaatgcaactttctagatccccaggaatatgttagaccttttcaaagttccttattttcctgatatttaagggttttggtggcttgcctcttatttgcttcaactggtatcaccacatcagaaagctatgaaaaacaattgcctccaattgttttcaataaatgccctatgaatagggcttctcaatgcttgaattctgagtcagggcaagtaaatactagcctcataaaaggagcttttccatgaggaaaagccaaagagatcaactagtaacagttctataatgatgaaaatgcttgatctccaaactccttcttccctgtcctatgtatgctgggttgctgattttcacagctgttactgttttgagtttgctaatttttaagtctatggaactaaggtgagaggaatgagaatgcagttagtgaaaatgccataaagctcactgttcttgccaagatgtattcacttattttgaataaattgttctagcatttgtataagcctttacaaatgtcaagagtaataacaaagtagattttgacaattatttgtcagtgttctaatttcttttagggaggagtaggttttcaaatgtccctattccactattcggaaagtgctttcaagtctacaactgccttgataccagaaatcaagttagatttataaaaggggttaatttttggcctactcacaaatatctttgctaaattttctggaagcaatcatcaaaacattaaaaaaagataatgtcttttcttctctgtgataatcctattagcatactatgtttatcttcttgctcaaaatctgcatacatgtggagaatattcttaaaaaaatggacaatacatattattctgcaacttgagtgattttacatagaaagaaatgggcattcctccatggatataaatttacttacatatattgatctgcttatcaaacttattctttaatcactctcataattgcacaggatggatctgttatgtctccttcagaccagatattcaggtttatagcatattttttaaacacaaaaaacaaaacagcaaatagatttacatactgctgccttcattcctatagagggaggtccattagagaaaacttaatgaatcaaatgtttgtgccaatttatttaataaaaagcttctgaatttttactgttatgcatatgtgcagatattacactgaaaaaattgtatctgttcctaaaataagttatcaaatcgtgtatttgtacccattaatcaacttctcctcattctttcctcctctcaaacagtctaccttctgttttcatgagatccatttttttcagctctcacatgtgagtgagaacatgtgatatttgtctttctgtgcttggcttatttttcttaccacagtgaccttcagttccatccatgttgctgcaaatgacaaaatttcagtatttttaatggcagcatagtattccattgcatatatacaccacattttttttctgtatttcttctaaaaaaaaaaaaaaaaaaacaggatacatgtgcagatcgtgcaggtttgttacataggtatacctgtgccatggtggtttgctgcacctactggcccgtcctctaagttccctcctgtcatcccacaccctccaataggccttgttgtgtgttgttcccttctctgtgtccatgtgttctcaaggttcaactctcacttatgaatgagaatatgctgtgtttggttttctgttcctgtgttagttgctgaggatgatgatggcttctagtgtcatccgagtccctgcaaagacataatctcattcctttttatggcagtatagtgttgcatggtgtatatgtacaacatttccttatccagtctatcattgatgggcttttggttggttccatgtctttgctattgtaaatagtgcaacaataaacatatgtcttcatgtgtctgtatagtagaatgatttatattcctttggatatatacccagtaatgggattgctgggtcaaatggtatttctggttctagatcgttgaggaatcaccatactgtattccacgatggttgaaataatttacatttccacaaacagtgtaaaagcgttcctatttcctcacagccttaccagcatctatggtttcctgacattttaataatcgccatttttgactggtgtgagatggtatctcattgtggttttgatttgcatttccctgatgatcagtgatattgagctttttttcatatgttcgatggccacgtagatgtcttcttttgagaagtgtctgttcatatcctttccccatgttttgatggggttgtttgtttttttcttgtaaatatgtttaagttccttgtaaattctggatattagacctttctcagatgggtagattgcaaaagtgttctcccattctgtagattgcctgttcactctgatgataatttcttttgctgtgcagaagctttttagttaattagatcccatttgtcaattttggctcttgttgcaattgcttttggcatttttgtcatgtcaatgtcctgaatggcattgccaggttttcttctagggtttttaaggttttaggttttacatttaagtatttaatccatcttcaattaatttttgtgtaaggtgtgaggaagaggtccagtttcagttttctgcatatggctagcaagttttcccagcaccatttactgaataggagatcctttccccattgctggtttttgtcaaatttgttgaagatcagatggttgtagatgtgtgatgttatttctgaggtctctgttctacttcataggtctatatgtctgttttggtaccagtaccttgctgttttggttgctgtagtcttgtagtatagtttgaagtcagatagcatgatgcctccaggtttgttctttttgcttaggattgtcttggctatacagggtcttctttgattccatatgaaatttaacctagttttttctaattctgtgaagaatgtcaatggtagtttgatgggaataacattgaatctataaattgctttggggagtttggccattttcacggtattgattcttcctatccatgaggatggaatgttttttccatttgtttgtgtcctctcatttccttgagcagtgctttgtagtcctccttgaggaggtccttcacatcccatgttagctgtattgctatatattttattctctttttagagattgtgaatgggaattcattcatgatttggctttctgcttgcctattgttggggtagaggaatgcttgtgatttttgcacattgattttgtatcctgagactttgctgaagttgcttatcagttcaagaagtttttgagctgagatgatggggtttcctaaatacaaaatcatgttgtccgcaaacagggacaacttgacttcctctgttcctattcgaatactctttatttctttctcttgcctgatttccctggccagaacttccaatactatgttgaataggagtggtgagactgggcatccttgtcttgcaccagtttttgaagggtacttccagcttttgctcattcaatatgatattggctgtgggcttgtcataaatagcttttattattttgagatatgttccatcaatacctggtttattgagagtttttaatatgcagggatgttgaattttatcagaggctttttctgcatctattgaaataatcatggtttttgtcattggttctgtttatgtgatggattgtgtttattgatttgtgtatgttgaaccagctttgtgtcccagaggtgaagctgacttgatcgtggtggataagttgtttgatgttctgctggtttccgtttcccatattttattgagaatttttgcactgatgttcatcagggatattggcctgaagttttctttttttgttatgtgtcttcccggttttggtatcaggatgatgctggcttcataaaatgagttagggaggagtctctccttttcaattgtttttaaaagtttcagaagtaatggtaccagctcctctttgtatttatggtagaattcacctgtgaatctgtctggtcctaggctttttttcgttggtaggctattcattactgcctctgtttcagagcttgttattggtttattcaggaatttgacttcttcctggtttaatcttggtagggtgtatgcatccaggaatttatccatttcttctagattttctagtttatttgcatagaggtgtttacagcattctctgatggtagcctgtatttctgtggggtcagtggtggtatcccctttatcattttttattgtgtctgtctgatgcttctctcttcttcttctttattagtctagctggcagtccatccattttgttaagttttttcagaaaacctgctcctggactcattgattttttggagggctttttgtgtctttatctccttcagttcttctctgatcttagttattccttgtcttctgctggcttttggattagtttgctcttgcctctctagatttttgaattctgatgttaagttgtcgatatgagatcttcctagctttctaatatgggcatttactgctatatatttccctcttaacactgctttaactgtgtcccagagattctggtatgttgtctctttgttctcattggtttcaaagaacttcttgatttctgccttaatttcattatttacccaggagtcattcaggagcaggatattcaatttccatgaaattgtgtggttttgagtgagtttcttttcttttcttttttttttttttttttttgagatggagtctcactctgtcacccagactggagtgcagtggcacaattggttttgagtgagtttcttaatcctgagttctaatttgattgcactgtggtctgagagacttatgatttccattcttttgcatttgctgaggagtgttttacttccaattatgtggtcgattttagaataagtgccatgtggcactgagaagaatatatattctgttgatttggggtagagagttctgtagacatctactaggtccacttgatccagagctgagttcaagtcatgaatatccttgttaattttctgtctcattgatccatctaatactgacattggggtgttaaagtctcccactagtattgtgtgggagtctaggtctctttgtaggtgtctaagaacttgttttatgaatctgggtgctcctgtattgggtacatacatatttagaacagttagctcttctcattgaattattccctataccatgacataatgcccttctctgtcttttttatctttgttggctgaaagtgttttgtcagaggctaggattgcaactcctgcttttttttgctttccatttgcttggtaaattttcctctatccctttattttgagcctgtgtgtgcctttgcatgtaaggtgggtcttctgaaaacagtacaccaatgggtcttgactccttatccaatttgctggtctgtgtcttttaagttttggcatttagcccatttatatttaaggttagtactgttatgtgtgaatttgatcctgtcatcatgctgctatttggttattttgcacactagtagatgcagtttctccataatgtcattggtttttacattttggtgtgtttttgcagtggctggtaccagtttttcctttctgtatttagtgcttctttcaggaacccctgcagggcagtcctggtggtaacaaaatccctcaggatttgcttgtctggaaaggattttatttctccttcgcttatgaagcttagttttgctggatatgaaattctgggttgaaaattattttctttaagagtgctaaatattggcccccaatctcttctggcttatagagtttctgctgagaggttcactgttagtctgatgggcttccctttgtagatgatctggcctttccctctggctgcccttaacagtttttccttcattttaaccttggagaatctgacgattatgtgtcttggggttgatcttctcatagagtatcttagtggtgttctctgtatttcctgaattttcatgttggcctgtctttctaggttggggaagttctcttgaataatatcccaaagtgtgttttccagtttgtttccattctcccttctccttctggtactccaatcaatcataggtttggtcttttcacatagtcccatatttcttggaggcttttttcattcctttccattcttttttctctattcttgtctgcatgtcttatttcagtaaggtggtcttcaaactcttatatcctttcttctgcttggtcgatttggctgttgatacttatgtatgcttcatgaagttcttgtgctgtgtttttcggcttcatcaggtcatttatgttcctctctaaacaggttattctagttagcaattcctctaaccttttatgaagtttcttagcttctttgcattgtgttagaacatgctgctttagctcatcatagttttttactacccatcttctaaagcctacttctgtcaattcatccatctgattctctgttcacttctgtgcccttgatggagagatgttgcgatcatttggaggagagacactttggccttttgggtttttggcatttatacattgattctttctcatcttcgtgaatttgtctacttttggtctttgaggttgctgatccttggatggggtttttgtgggggctttttgttgttgttgttgatgatgctattgttgttgctttcttctggtttgttgttctttcagtagtcaggtccctcttctatagggctgctgcagtttgctgggggctcacttcaggctctattcagctgatttgctcccgtgcctggagacgtcactgaaggagcctggtgaacagcaaagatgggtaccttttccttcctctgggacctctgacctcgaggggcaccaacctgatgccagtaggatcactcctgaatagggtgtccgacaaaccctgttggagggtctcacccagttgggtaggatggggaacaggacccattttacaaaacactttgtcctttggtggagagagtgtgcttcactggggggaaacccactcttctgggctgcccagattcctcagaactaccaggaggtgaggctaagtctgctgctttgcagagactgtggccattcctccctttaggggctcaggcccagggagatccaaaacctgtccctgagcctctggctggagttattggaggtcctgcaaggaagcccagcccactgaggaaggatgggtcagggttaggcctgaagaggccctctggccacagactgccacagccagtgtgttgggctgtggggacaagtcttgggaccaaaccttccagcctttctggctccagcaggtgaaaagtgcagcctggagctgtagaaatgggtgctgcccttcccccacccagggagcttagtgtgttaggcagttgcaagtcccagtgctggctgccccttccccaaggagcttaaaccacttagacaacaggcagctgcagttggtgctggtcacccctcaccccaggaagtcattaggattaagcagattccagctgagaggctgtaacaatctgcgctttctggggttgggatgctaggcccttggtggcatgggttcatgagtgggatcttcccttccatgggttgcacagttccgtgaaaaaagcagattgcccggctgagtagcacgctcactcaccacctcccttggctggggggagggggttcttctttcccatgtggctttcaggtgggccaccacaccacactgctcttccttctcttcatgagtaggaaatagactagccttctagacaattttgatgacagaacttggatacctttgttgctggtgatggattcacatgcttattatgtttttttttttttcatatgagtctctgaatgccagtccttctagtcggccaccttggtcctgaccctaaattattactttctgtacattaacttctactatacctttgtgtttatttatgaaatgcttacttgtttcttagggcttatttgtccaattctaggtcaatatactattatttgtaatgttttaaagtcaagaaagagtgtttctcatctttttctccagcatttttttagttcttagatatctgttctaccatatcacaccaaagtcatttgctgggtttttgtaaaatcaagattttgtttgaaattgtattaaatgcatatattagttgtgaaaataattcatttataaatatatgatatctcctgcatgagcacaggatattctctgtttgtttgtggttcttttatgtaattttcaataaattttatactttaaaacaaattatgaccttcaactattttattaaatgtgtctttctttcttcttttgagagggggacaatgatgataagcaaaaattgcccccatatgtataacttacatgttttattaaattaccttaggattttttaactctttagtaatttctagggtttttcaaagtgtatcatcataatatctgtagagtttacttttatgtttcttatggaaaattgatatttattacttaatttacatatcctattacattagttaaatcattaaagcaattctgagtaattgtgaatgggaagtcctgatttctattttactttttaaaattaattaattaattagttatatatttaatgttgtgttcttggaataaaattaatttggtcatggtgttttattcttgtaatacactactggattcactttgctagtatttcactttcaattttatatccatgtataaaagtagtatgtatatcatgtttttatggtattatgtttattagctttagctattgataggttttattgttgttactttagctaataatatgttttgttgttgctttgttttgttttaggtttcataaaataagttttagaacattgtacgttattcagctgtttaatattattgatgtaaaataggtataatctcttatattaaggtaagtagagcatatctggaaagccatgtgggcattaggacattttctaatggcagattatgtttcccatcttttctatgatcactggactctacaggttctctatattttggtatttaatttgagaacatgattttctgttgaaaatcatcctttctctagatttgtattattttcattaccaaatttgcccatattttttgaaatttttgtaaatatctcctctgtgtacatacttacatctcatttattatatataatgtacatttttacttctctcatttaaaaaaaaaatcctttctactagtttgcctgtttgattttttttttttttgaacagccttcttttagttttatttatatgtatgctatacttttgggctttttgcttcattaatgatagttttttacttctttaattctccatcctgttattttggttgattttgatgtttcctgtgtctcggaggctttgcagtgaaacttgattgttaatgtaattgagattcagaagctatgagatgtggctaatatcttatctgtaacattgcttaaacatgactttgtggaactcttgtggagatggtaactttttcctgaatgcttgaatcagctttgaactatgcaatcaatttacctgtaatccaggaggctgcaagaagataggtcccatggtaaatgattgcaattcttttatctggattcataaaaatcatctgctaaacacttaagacattatattatattagcttacattaagtactctgctttttcatattgcctcacactaattattatgctttggttgcaaatgtattttaaatcttaagagcaatccaaatggcagttttattgtttactgtggtccttgctgactatagtaaattgtttgctgactcagcttaaatttagaaaatgtgcacatattttggatttcttcccagaaatgaatgtggctataggtaatataaatacataacaaatccccttggatttagaaatttgtggaatttcctttggcattgcagattagcagttaatccttctttcttagctaggtttaaatattggagcaatttgtagactcttagaagtaatagttttatctggacactgattattttgctggaaagcaagaaatcaggtccacacgaagaataccaaggagagaaacatatgttaactttaaaaaacaaacaaaaaatgtcaatttgtatattggtattcaagtgggagcgataaaccattaatacacatataagggatttcggagaaaatgttttggtagcagatttctgtccttggcatctgtgatggagggaggatgatttgcgagtcaactgtactgcggtagaaacaacattgggtttcatgttagtacatgtagtttcaaatccggggtctgctattcactgtttccatgaatttgatagtcactttcattcggaaacttcattttcacatgcataaaaagttgtataaatatcagtactttgtacaagaggccaattcaatgactgtcctggttttgcagggaaaatgaaccggcccgcacagcgatgagagagtgctgtagtaacatgggcattggaagaggatccccgcaaatctttaagaagagggacaaaattggttcctagatggggaaaaccaagggtggtgtattaataacagatgaaaataaggaaaagaattaaattactttgaaaattctgagggaaagggaatcttcaccacatcatcagaatcacacacagcctgctgtggtgaccaatcaccagtcagatcaccaggaggctctcttactaaacgttgaggatatttgcaagttttagtccataatgcctggcatccgagtagagactcttgtcccttacaattttactttctttccagagcttgataatttagttctgatacctattattgtgggattgctgttgtactgtaggcaaatgactcacttcctcaagttcgaatttcttcatttttacagagatggtgatgatgccttgttgttagagtgagaatggtaggatataatgtgtgtttacattcactgacctggtcccttgcctagcattaattaatgattgatgcatgtgaattacctttccttctgactacttgatatgtttcattaggcattcattcaattaatagtcattgattctgactctatgctagagacactactcagtgttacacgtgaaacaagattcctagtcccagcataatggagcttgcgaatgaaagagggagatagatattaaatcagtcatgccagtaaacataattataaattgtaaggtggaatttgaaggactcatagaaagttctttggcctggttaaagacgcattcacagagaaatggcaattaactgggatctccaatgtcagtaagagttaataaggcaaaggatgggtttagtgagaaggagatccacgtggaagcataacatgggcaaagtactagcttcaagaaggcttatggaacatttgagcaaataaggaaacagcagggtggctggagttcagagaggaattgggagatggtgcagcacagtctccatgcccttctgcttctgctttacttttaaggctcagtgttacctatggaaagaaaaatagtcagagtctacacatttatcaaattcatcagccagaaatcttatcagaaacaaaaagtaaagccttcaggtgaggactattgagcaccaaagatcttatttctgtgtggatttttttttttttttttttttttttttttttagtgaaataagatacatcgaggaggcaggtgcatagaagtcacttggaagtgacttctaacaggcctgttatgccagctggtttttggtgttgtaggctgaacgtgaagttgatataattgggctcagtatgtgtctttccttagagggagacagccgctagaataataaatcagcagtggaactttcaatagatacttctggaatgtctttgacttttacatacctctcttggcatttagatttgaatctgattttcagagaagaaagggttatagatcacaatctgagtcttcaacagcatatttgtagaccttagaggagtaagaaagaaggggagagggagagaaaaaagccctgggacaacttctgtgatgttaggatccaggggatgcacttggtttttttctccattgtgatatcccacttgacacatcacgattacaaatgatgagtagcctaggacaaaaccaccagcttcggtaatttgagttatcactcatgtaataaatatttattggacacctgtattgttctagatggtaaaaaaaataaaaaataattatgtttctttcaagcacttcatagtccttttgggcgctagacatgtggacaattacaataatgcagattaacttttttaagaacacacagtttcatgcagtttgttaaattattttgaccaaatatctcatcaatccttttacaaccatttttttcatatgggacaaccaagacttcaagaactctagtaatttggcaagtacccatagtttctaagtgacacagctaggattaaatccagtttcctcttctgtacagatcatcctcctaatcactgttatatattattccaacaaaatgtgtcaatcaaagtatatgcaaaatgccaagggagcatctaggagggattatgtgattctgactgaaataactgaggaaagttttaaagaagaggcaatatctgtgctctagctcaatgctcttgatctgggccagttgtcttcaaaccctggaaactcactatgatgtgataaacacagagttcctccatagtgctttcattatgaagaaatgtaagaggtgaactggtcacctatggggataatagggaacacagccgttatcataaatactgggaaataaaaggaaagcaataatttgcacttttctatatcaaagtatcccagctaataaatgaaagaagaaatgataagactatcaacatttggcagtccttctccagcaataaattaacatgttcattctcttaaaaaaaatttgttgtttgtttgtttttgtttttgagatggagccttgctctatcgcccaggctggagtgcagtggcacaatatcagctcactgtaacctccgccttttgggttcaagttattctcctttctcagcctcctgagtagcagggattacaggttcgtgccaccacgtccagctaatttttgtatttttagtagagacggggtttcaccatgttgaccaggctggtcttgaactcctgaccttaggtgatccacccaccttggcctcccaaagtgctgggatgacaggcacaagcaaccacccccagcccaaaaaattattctaatgtgactaaagaaaagaagaagttgggataattcatgagctgcattctatacacagaatgagacaaacaattgataaataaataatatataatttaacttgtgactagtgctgcaatgaagatgcactgatagaaaatactaaggtggaggggggaaaatgaggggagggccttcttgattagagctagacaggaccaatgaaaaggcattagacatgtagagctactagaagtttccaaagcagagggaaagacaggtgtgaaagctccaaggcaaattcaggacataggaacagaaaagttttcattgaaactatattatgagaagcccataaaaaacaattggaagattgcctctattttcaggtatcttggctcattttcccttccaaatgtttacaataaagagtgctacaggtcaaatccttgactgatgttattatcagattctttgtaaaattacttaatacagaaccaacaaagatggatttgcataagcagtgatctgaatgcacgtaacatgtgaaagaataaatgctataacaggctgatcaaatatttaaggaaaataaggtttaatttagtttcaaaagccatgctacagagacagttgagatgctaattaatatcctctgtctaactccagcacacaaagcatttggaaggtctaaggttcttcttttcttaagcaatttcttcatagaggctgtccccatgccagtttttttttttttgtaccctataacttctcccagaatgacatagttaaatcccattatttgagctgccttggcagatgactcccaaactgtatgtatcccttctagatacacaccagggtggtcagcccaagtacccacaaggacataaacatttgaaggacacagtagaaaattagagtattgtggatgtcattcctcacctaaaggccttggcaattatctatttaacggatctgttttttcctgtgctggacaaataggacatagctttaagttttccttaacagcaggatgttagcatgtcacttctatcctaggttcatctagagaaggatgtaataagcatgccttcttaggggctctctgtgtctaaaatgaaattttctgattaaatgcctttctcccactgtttcccttagcttgctggttggtgtagttatccaagtactttctcccgctaaaaacttgggaaataatttggattttcctctcctctccacctgtcataccactcaaacagcaagacttactgattctataccctaaacatgtgcctgggagccaggtccttttctcctctctgttgtattccagtaaaatcactcccaaacttgtataactctgtttcactgatttgggtctttctatttcattctccagaaggccaccagcctgaatttattaaaagtctcatttcattacactgggtaaaggcttctactgagtgcagaaccagtttattcttagctttacattcaggctactttactatctggcctcaacatacctaactctaatgtgcttctttggccatcaacactcagatacttaaatggggattaatatcctttctcaaattatctgcattcctaagaccacaccctcacttgtgataccaagtgatcactatcagaggctgccattttccccaactacctcctacttatttgttcatgacccagcttaatgtcagaatatccaaggaaactcccttcacatttcaggctgataaggtcacttccctgtgctgtgaatgttctttatctgctttggcatctttctcacaggatcatgcactttgttccaaaatggaagaaactgtggactttaaactcacgcagtattggcacaaagtaggtgtttaataattatgtaaaggaatataaatcattctattataaagatacatgcacagatatgttcattgcagcactgttcacaatagcaaagacatgggatcaacccaaatgctcatcaatgatagactggataaagaaaatgtggtacatatacaccatggaatactacacagccataaaaaggaatgagatcatgtcctttacaaggagagggatagagctggaagccattatcctcagcaaactaatgcaaaaacagaaaaacaaacaccacatgttctcacttataagtgggagctgaacgatgcgaacacatggacacattggggagaacaacacagactggatcctgtcacggggagggagtacggagaggtaaagaaccaggaaaaatagccaatggatgcttggcttaattcctgggtgatgggctgatctgtgcagtaaaccaccatggtacacatttatctatgttacaaacctgcacatcctgcgcaagtactctggaacttaaacgttgaagaaaaaaaattcaaaactgcttcccgcaatgtcccctgcccccatgcctgaaaaccttgtaagattttggttctgaattggaaatcgtatttctttaagaaggcagatttcttattcctcaggaatctatatacctgctcccagaaacagtagatggtatgtcattagacagaacctcccctgagggcatccctagaatgccagaaaaatggatcaagaggagacagtaattaggagttttctaataggagaagaagaaagacaggaatctgaaacaaaacttgtttaccagggctgttgttgccactgcaaactgtgcaagaaaacaacaatgtctcaaatgctactctctaggaatggagacagtgggcagaaatggatgcttctcccaaattatggtaaatgcagagtgccaaaacgagcttctttctttctgagaatgttcttctatttgaatttaagcttataggccacggagtgcaggcaaccagcagtcggggaggccaggcacagtggcccatgcctgtagttccagcactttgggagctgaggcaggaggatctcttgagtccaggagtttcagaccagcctggacaacatagtgaggccccatccctaaaaaaattaataaataagaaaaaaaattatcattgaaagaatgagttaatgaattaatcagtgcatatatgttctccaaaatttcactcacactttaaatgttgcttttctaagtcagtatgcttcctgattttacatgtatttattcttcctacctactccttccacccccagatgcacacacacttacctatggctttcagccatttcatattagggaatttgcctcattgttgtattctatgtaacaactagcagagttgcattcctctcttaagtagtttttggtttgaaaattgcaaaagtattactgaactttggaggtgttcagaaactgtatgtcggaagagcttgaggctcctctgcatgtggtattctagtggatggggaatttttcaatgaatatacaaaatctccaaggccttctgctgtgtaaaatataaatagctgctcttgatgttcacactcattcctacacaccttcaactggtgcaagacttatcctttagagacctcctttcactagatacagttccgttacgccttttaaatgttgagtgatgacaaaataggacttattggaggggtaaatgagggatggtgacgagaacattgattttagtcccaaatagaggaagcattcaaaaattatctagtttccccaagaaatgtgcatccctaagaaatacagtgctgcggataatttccagtcagtgtctggaggatatcttcagccattagaatcataatctactattagaaacaggtattcaattttactagggaaatgtataatgtgctccacttgtgatttttctggagaggaatgtcaaatttgtattttgcctatggcagcccccacccgctttacagcatctagaaaaattgggatttaacaaggaagaaaacactagggaaaagaaatcatgtttgcactgcttaagatatggatttaaaaatatgtattttaaacaattttacttatgaagttctctgcatacatttacagagtattttctatgaaccaggaaccgagcatgtggtggatagttaggcatggtctctgcttttcaagggctcatatcttattaatatacttttgtggatgtaacagatttaatttttaatgaacataaacatagggatatcaaatttgtgttcaaaacatctaaatctcaattctctcccacaaatggctgcttctttccccagctcccctgtattagaatgctctcacctccatatcaccaaggagatttctttctggatcttgttattgataatgattttataaaaagtttttgttcaacttttattgcacttaattactgatttggtgaattcgtatacatatatattcatgtttatatattcatgcatacataattgtctataattcagcaattatgtgtatatatatatttatttatttgtataacattgactatcccatttgtaccctcaaagtaactgaaaactctattataaactccagtgcctgctctgaaagttaactgtcaagtcttagctctgcaatttctcaagagtaacataactccttctctcattcattgcatattatcttttacactgaatgaataggggaaatagcaagaaaaggagaagcactggaatgaatgcagcagccatcaggccctttattctgttcctcaagcaaagactctttctgcgagcctagggcaggtccgaaagagatggagctatctgaaccacgtggggccatttggaacaaggcttccagatgatgcagtgagctaaggtgaggcagcagtcagcttccctggtagtagaggaagttttctcagaagagatgcaagttaaacaggggtccaacaaaggaagaatgtctagtggacattttgcaaaacataaagtcagctgacagatatctggaagagcctgtgagatcttcagaagaaaggccaggttttttgttatccttgcactcatgcactggcatgaggcccagcctgaatgaaagatagaactcatttttcaagatgaaatcatctttgcatttgccttagcttgcggctggtctggcttctgagattgctgtaggtactgaggaagaaaaggaaagaattcataatcacaatcaataacagagaacgaataacttgaagtctatgatgagtcaatctgtgtatgcattcatgcattcttgcatttgtctctactaagatgaacttaaatgcccccaagagacacattcccagggactcacatcttcagcacatcaggacctcctcacatggggccacatcaagcatatgtgtggtcgcaggctgtcattccctactcaacgtctttcagggtagaaacagctccacttactccaatcatatacgtttttttgagcaacctgtctgtatcaagggcagtgtaaagagtgaagatcaaaacaataactcattcagggctgtaagaactcacagtctgatgggagagagatagcagaagactatgggtgacatgatacactcttctcctccataacaagacactagccatgggtttggaaagaagctctataaaagtggtttctgtggattttgtttgtttgtttttaagcagtatttctgcaagaggatgcatgacagagtggagtggtctgtagaaaaataagtttgagatatgcttttacttttatacatcaagttcaacatttccctctctggtaaatttttataaaatggattagcacactacaagttctcataaatcctgcagtgaagaaacctacttgttttgtttaagttaggatttaattacccccatgggcctctctttggggaatgctgctttatatcttccagacggcttccctgagttattgtgggtgcctataggcctggtgagcacagataagacctgcaatagaacccataccatcagagcacttgaggatggataaacctttggtctcattctggctaatcttctagcaagtcaagcagttaaaaaccctgaagactggccttagcagctggtcactcagcttctccttggtgggaaaactcatgctttatataataaaccaaaatctacaacttttgactgctctttttgatgttgtgttctgaagaaatctgcctacaccctcttctggagcagatttgaaagcatccctcaaatctcttgttgccaaagcttctcagaaatttgactcttcaaacccaaagccactctctagtcaaactcttctcatcctctgctcaggtggatttttaaaaaaggcactttaaatacgtttattgattgcataattagtgtggatttaacttggtcaacacaaaatcatttatcaagttcaacactgacatttttattttggtaaatcttattgaatccaacaaaaatttccatgtaatggacagcctaataaaatactcaacagttgccctgccacaactgaaggctttgttttccatagtcattctctattagtgagtgtttctctctgtttatatgttttccctagtgtttaactcaacatcatttaatcactaaattggtatcacaggtatttttctaaattaaaagccttatcatctacgttaactgcttggctactgaagagttgcttcttcctgatacaaaaaagaatagcaatataatagtaagcagttctgtccctctgtaatacctatgtgtgccagatggtggtctaggtgctgtaaacaattcaacttatacacacctcaagacaactctagaggaagatgaaattatttttcccattttataattagaaactgaaatgcagggaacttaaataactcatctagatgactcaaattagcatatctagttggagcttgaatttgaacccaagcagtcttccttcagagtccacactcgtaaggattatattatatgacttgtctcagttgaattagtacagatttgatcctagaaggcctccagtacaattgatttggctgtcaaatatttaaagaattgaagaatcacctgtgaccatgatgaatagggagaattcatgtaggtaaatattaacattagaaaatttatctgataaatgcaagaaatttagcaaaacccaggagtgatggtgtggggagcttgggtgtttgtttcccatttcacaaaacaaagcagccaaccttacattcatctcaacaagtagtttatttaacttctcagaggaagagcagcaaatgtaaataaaatcaataacagcgactgaaaaatcttaacagggaatgtatatcagctttcctctgtgtgcctctgcttgtctattttattcaagatactgaatacatgatttctcatttgggtttctgtgctgtactaggcttcagcaatatatgcatcaaacattttgaaagtctgccccaagaggcaaaaagaccatgtgaattatacattgcctcacagagtgatgatactgtagacctacttgcatgtttgtttttgaagaatttcatccaggataaaaaaagagaaatatagttgaaagggttctataggtttgacaattcaaaataaaaaaatgttatctctatggaaagtcatagtggttaagtaggattcatatctcttctatttggaatccagcatggcctcttctattgttttgtctgccagactgtgagtgtccccagatctatgatattttgcaaaagctgagttgttatcttagctgatgtctaataaccctatttatggcacagccatgttggaaataatcattagtattcttagccttgttctataaactcataatgatgtgtttcattgtttgtggtgttagccttgggctgttagacacaattctgtttacgactatgaagtcagactgtccatccagaacatgacggattatgtattcactacatctgctgaatcagctgtgtctgtgcagtgaataccacatcctcattttcagaactccatgagctttcaggtaaaaatctataagatttaccttgtaatgtatagaacacaatttatttcattttcttccgttaaatttattccttgtggtttctgttatccatagcttgtagtttgcattacaagttgaaattcctttttgtttttgctgtggtataatatccatgtgagaatcgtctttcttcatctcagatagagaaatacaaaccacccttttactcattcactgagagactgaactagcacatttttataaaactggatcaaaatgtgcttgtgatcagctgtcatcttgtggagtttccttttttttttcttgccacaattggagttctaaaccccttataataagcacatatattagatatagtcatgtgttgattcaataacctgatttcttccctcctttggctttatcacatttgtcatataactgtcaagtctccctgagtatttgcccaacatccattgagcacatggcaaggagaaaatgtggaggattttatggagatggtttgaaaggggattcccatgccttctgtccacgtttctgtggccaacagtcagtcacatgatcccacttagatgcaaggggttctatataatgtagtccctggctcaggggatgccccagagacagttctatactctaaaagaggagtatgaatccttagtagacagttttccaactgtaccactctgtgtgatcttagaagactttctgagcctgttttcttatattttaaatgaagagaacttaactaccttacagattattattattattatatgggattatatacacaaaaaacatgtgagctgaaaaatgctacacagattcattatttttataaatgatatgagtaaaatttatttatttatcttaccttaacctagagaattagaagagcgctcaggagctaggccgtattatgagtaaattgtctttgtcttcataattgtactttttcttcagagcttcttttgtgtctttatgggatgtgccaacagagcttatgaagtcaaatcttacagataagaaggaagagtctgggaaaaccaggatgattgattaccctatctacaaaccgattttgaccatttccagggtttgttgtctgtaaccattgcattaattcaatagtaaaaattatcaaccaaagacaatacctaaactaagcatcacacaaaattgtctccacaatagctttatgtagagagaaaccaatgtgcaaggtatcaatggcacctggtgtctatactatgagaatagatatagggaagatcatgcacaggttaaaagcctgatgttttgagctaaaaaaaaaaaaaaacctagtttgaacttatctgtacattaaccagttgcatagatctcggtgagttatttaacggtcttgtcttctgtttctcatttattcaacagagagaaggttaaaagcatgttgtttttattagagttgaatttgatgatgcttctaaagggttagctgcaggggaggtccactgtggggatttagccacatgcttttcatgtgtcatttttacatgtcacagaaatgctatggatatataaagttccacagtgagatagtcataaaattggaactggaactcaggactgtctgaatccaaagctctctttcataatcatattttgttccctttctgggcatggcattgtgcctggcctatggcaattgctcagtaaatcacagcagttattgttctctttcatatctgtgcccagatcaattgccagatggaagtgggtattttgttctttagtcatctatatattagacttgagcattcctcacagtgctagtggagccacaactgccccacaccctctgagatatggctctcccagaaccttcatagacaaggcataaagttgtttgctatgtactttatctgtattaacaattttacctatttgtaatgggtttgtttttctaagaagtttgaactatgagtactcccctttctaaaactggttatgaggaagaatagaacaggatataaaagaatatcttagaaacaaagaatggagaatatatgctacactcgtgttcaaacagttaaaaaaaataaaaaaatgccaaaataacttacaaaatagatcaaggagacaaaacaaaaagcccgaagtgtaaaatataatgtattattaagctagtatttacaatgaatgaggagaagatcaattacttcatatatactgcacaaccattcagataaaaaaagttagttcttcttttcatctcaaaacactcaggaaagcacccaatttcagatggaccaaacatttaaatgtttaaagtaaaactacaaaagaagcagaaaacacaggtgatatctctttgatttcagggagggaaaaagctattcaaagcaaacaaaaagttaacaatgaaatcaactatagaggcaaattgtatatttgggaagttaactgctaaaggaaatctgtacatcaaaaagcatattaaactaaattgagaggcaaatattaacctgaggaaaacatttgcaacgtactctcattgagttttcacaatattcctgtgaggtagataataatatctccatttataatgaggaaattgacagcacagacactttaagtaatttagtaatttgcccaaggtcattcagctaatgagtggagggactggaatttgaaccctcaaaaactgaactccaagcactctttacctcacacgtggctccctcgagtaagaaaacagctctagagcccagggccatgattttgtttgtttgtcccataataagcagccatttactttcagataatatatagtcatacattatttaatgatggaatatgttcttagtaacgcatcattaaatgattgtgttgtgcaaacgtcatagtgtgtacttaagcaaacatacatggtatagcctacttgcaaacctaggctatattgtatggcctgctgttcttaggacacaatcttgttactgtactgaatactataggcaattgtgacacaatggtaagtattactgtatctgaacatgtgtaaacataggaaaggaacagtaaacatataggacaaaaggtgaaaatggtaccattgtacagggcacttacatagagcttgaaggcctggaagttgctgtaggtgagtcagtgagtgagtgatgagtgaatgtgaaggcctgtttactgtacactactatggacttcataaacactgggcacttagattacactaaacttttttttttttttttttgagacggagtctcactctgtcgcccaggctggagtgcagtggcgcgatctcggctcactgcaagctccgcctcccgggttcacgccattctcctgcctcagcctcccgagtagctgggattacaggtgcccaccaccatgcccggctaattttgtttttgtatttttagtagagatggggtttcacctcgttagccaggatggtctctatctcctgacctcttgatccgcccacttctgcctcccaaagtgctgggagtacaggcgtgagccacggcacctggctagattacactaaacttattttttaaattttatctattcaataataaattaaccttagcttactgtcacattttacatttaaacttttaaattgtttcactttttgcctcttgtaatagcacttagtttaaaacacaaacacattatacagctgcccaaaaatatctgtttttatatctttattcttaagctttttactatttaaaatatttttctgtcacttttttttttttttttttttggtagagagagggcttcactttgctgcccaggatagagtgcagtggtgtgatcatggctcactcccacctcaaactccttggcttaagtgatcctcctctggctcctgagtagataggactaaaagtatgtgctacaacaactggctaatttttttttattttttaacttattattattgttattatttggtagagaaagggtctccctgtgttgcccaggctggtatcgaactcctaagctcaagcaatcctcccttcttggcatcccaaattgctgggattacaggtgtcttttactttttaaaactttttgttagaaagtaagacaaaaacacacacactagtctaggcctactcagggtcagaatcatcaatgcatcactaggtaatagaaatttttcagctccattgtaatcttatgggaccaccatcatatatgccagttcctttttcactgaaatgttattatatggtgcatgactgtaattttgggatttctactctgattttttctaactagagtaaaagaaagttcaatatttaatacatagaaacaaaattgtgacattaaaaaaacaaataaaacaactccctagaaatatagagctgccattagaaacgctgcagcaagcctcattgtctcctgagtaccgggcctgacactcggcctgccccaggtctggccatgtctaagtgctgaggaaggaagcctttctctagagttttggtccacgccagcatccttttgcagttctcctctgtagcctgcattttcaggatgcttccatactacggaatgtattatttcctctccttggaatgcctgcgatcatcataggtatctaggaaaccatttttcaaagtgctagacagtattaggatatctttgaagtcaccctagagctacgtaatcattcctaataataaaataaaaacttccatgcatctgtgatgccactcacactagataataattttatgttcatttgccttattcctctattaagctggtctattattaagcctccaatttgtctgttagaccaatgatgcccaacctttttggcaccagggaccagttttgtggaagacaatttttttccacagacaggtggtaggggaatagggggaatacggtttcaggatgaaactgttccacctcaaatcatcaggtattagattctcataaggaacacatagcctagatccctcacatgtgcagttcacaatagggttcgcgctcctttgagaatctgatgctgttgctgatctgacaggaggtggagctcaggtggtaatgctcgcttacccacctctcacctcctgctctgtggcctggttcctaacaggccatggaccagcagcagtccatggcctggagattggggacccctgtgttagacaatctctgtgtctcctgaatccagcatagctaggaacataggaggagctgcatgatacctggtgagctgaaccaaactccacggtgaaacaacagtgctctgtgtttattctccaatgtgttcatttgagttccatatcataattcagcacacactgggagcacagaagatcccctgaccagcatcagcctgtagggacctgaatgtcagtgaaggttaccgctgccttgtggaaaaggcactgatcactggaatggaaagttcaggacaaatttggcagtgataaactcaacccctctgttctccctgggctgatttttccgctaagaaaatcttaaggagggtctagcacccactgtggggttaccatttttaaagagcttgatgcacgtcaaaaagagcatgtaatttgggtttgaaagaaaggaagacaagaaaggcacagaccgtggtgtgtgtgtttgggtgggtggggtgtgctggaagacagggcagtctgccactgggcctcaggccctgagagcctgggagagtccactgtgtttctccaggatcttccctgactcagttccagacaggctcttcacaaagactcctcagttcatcacatgattcccaacccaaccaggggacagctgtccatgcttgtgctgatggtctagctggacaaagaaaatgggtgaaccagggtatataagttccttggaggactgagagatgtagaaactcttctaagaagagtgtttccctctttggctttgtaatcttattgcattatctttattatcaatgacaaacagagcatccactctgttccagacattttcagaggtgccagggtacaaagatgaactccatcctgaggaactggtcacatctgtctatagggaattcagtctatttgtgtgccagaagagcataaagacactgacaaaaagaaaagtcattaaggggccggcttctggaagagagatgtcactggagaatgaagtagaaaaaggctggagaaactggaaccaaaggcaacagggaccaagacctcgctctgtctctcaagaaggacacaaagaacagtgattatagtgtacaccttggagtaagatagacctgggtttaagtccctactgtgatatttctaaattccaaagcctacacccaacctcatgcagcatcagttttctaatctgaaaaagggaagaaagaatatgtatcatcgttgggttaaaagagttgaatactcacataaagcatgctcacatagtgtactcacaggctcacctgaggtagcattccccatgcctcagtgacttgtgggtagaaatgaaggcttactaatattcatgctcagaattttcagctgcattgcctccactggaggaaacagaaggtcatcagcctcctgcattgagtctctccattcactggcagtttctcttagattgatacagtctgcttgccacactgtagccagagcagtttgctccatcaccatggcagggctgctaccaaataggccttcttgtccatactcctgtaccatacctttaggtcactggggccactgtagaatcaaagcactttgtttagttcttggcatgctctattacctgcatactaccgtgagccacatcttccatcaccctgtttggttctcaccattctgccatgtctgtgagcctttaccttgcattgctgtgcattgctgtaggctgagggccctgcacctacttcaggtttctctacagagttgcactggtttctaattgttgctgttactaccaccattgttagtgttatcagcagacttttttgactgatcggattggattgtaagcaagtgcaagtatatgtattcattcattcaaaaaccacccactgagcaactattgcatgttaaatattatttcagacaaggaggatgcaatagtgagcacagctgacccaatccctgacctcattcagaagtttatagtctagaaacatatcttctctcccatctttctgccggagaaaagaaaaacagtgctgctctgtcctgtgttgaattatttctcaacatctctgcatcatcctttaaatgtagtctgtgctcctcccgtctgagccctccaacagcatccacttgatcccagagaaaggaagtaatattcacctaaaaataacaagcatatcaacctcagcttctgccagccatgattccctgggaataccatttctttcaggagctggaacacagaaaatatcagcagaagttaccccaaattgttgagcccccttggttccagtcagaatatttttcaagaaaaaagataattctacttcatttgctcattgctctggttgtcaggagtatgatacggaatacaaaagacaaagaatcagtttggaaactgctagaggaattgagtaatggcaaggtcatgattctctttattttgatagctggtggggaatttgcttcttgcctctccctaactggagtgaggattgcatctttctccgctttttgctgcctacacaatctcactttctttacaagcccgttccattacattctctttctccatccctttgccatttttcttatgtgtaaaacaggaataatagccatactgacatcaagatatgttttgaggactgagttggtacattgggttatggaaacatgtccacagtagagcgcttaagggttgtgcggctaaggctttggagtttggcttcctggcttcgttatttgctttgacttcccttaggcaaattttaacctctctttgtaaaataaagaaactgatagctacttaaaagttgtagttatgacttacaaatcatgtctacaaagcatgtagcacagtgtcccacatagtaagtagtgaatataactagctactaaatttatgatgaatattattatatctttcttttcctccctttacctcaagagtgctacttaatttgctctgttttgatctctgtctttcatgcaactctctattcatttcggtgcaggaaaaaactgagatgagaatgacataaaatctggagacagtgcaggctttctggcttctcttcttagctacacgtgcagcagggttatggcagtgcagggaatcagcagatagggtctctggctgagcaagaagttccaagggagcacagatatgacactgcagggggcctgttctcaggggtctgcagtccctgtgtgaccctgctagagccttgcaccagcagctgcagtgtgaggagcacctccccaagaagagccctctatcctcccacatgcctgctctttgagcaatagtcatctgttcaggacgtatgcattatttccttctccatttgtcatatggattgcctaatatttatctgtgctgtttttcacattactctgaaaggtttctaagttatacttctttatgtgctcttggattgctggcttacaccaccactgccaccaccatcaacaataccacgactgctaccaccgtcaacaatatcagcactaccgccaccatcaacaatactactgctgccaccaccatcaaaatcatcaccattaccaccatgaacaccctcacaaataccattatgatcagtatcaccaccactatcatcaacaccatcaccaccacaatcaccaccattaacaccattaccaccatcaacaccaccaccaccaccaccactgccaccaccaccatcgacaccatcacaaataccattgtgacaactatcatcattgctatcatcaacaccatcaccaccaccaccaccatcaccaccaccaccattaacaccatcaccaccagcacccaccattaccaccacttccactgtgtgtcaagcttcctctcctctgggacattttttctgtttctggctcagacttgcacatccctcctatttgctttttctgtttccacattcttatcattgcacatgtcacacccactaactgattttggattgaatcctataaaatacagctcatgtagatttatccatttgaaattgcttaaatttgaccgtttttgactgtttgcttatttcacatattcaagctggtatttatctacgcaccccattaaactgttagttacgtgagaaaacaaggagaacttttactctattttggcaacacctggcacagtgcttgatacttgatacaggtgcattgaataactgaatgaggcatatggcataagctttatagactctgaagcagtattcaaatgtaagagactgctgcagtaaaacaattgagcatataaaaatattttcatattaggccgggtgcagtggctcacacctgtaatcccagcattttgggaggctgaggtgggtggatcacctgaggtctggagttcgagaccagcctggccaacatggagaaaccccgtctctactaaaaatacaaaaattagccagacatggtggcacatgcctgtaatcccagctactcgggaggctgaggcaggacaatcgtttgaacccgggaggcggaggtggcggtgagctgagatcacaccattgcattccagcctggacaacaagagtgaaactccatctcaaaataaataaataaataaataaatctatctatctatctatcttcatattaaaaatgtgacctgtccttagaggttgatttggaaatgaagaaaagaaaagtgtgagactttgaatcatagaagttcaaatatattccagagttctcagggtaagtcaggggcagccttgggggatgagtaggtagggtcccattttcttcttctgtctctgctgctctacctttatttgtttgtatattaatgatccaaatatacatatacacatatatatatatatttatattactcataagaaatttaaaaattctgcaatagatgtcatggagccaataaaggacttcaggcagggaaatgtcctgttgagattagtaattttgggatgtaatttttgtttggggcaggagcatcagtgatggggtgaagagattgaagctggaggcccaagggtcagtgaggagatgggagctgagaagaggagatgggctggacaggaagctaggaatattcatctcactggaggatgcggggactgagaggggaagtctgccttgatcccaagattgggggtgattagggggctatgtggatagcagtgccattctcagagacaggtgctgtaagaatagttttggggagaaagatagtaaatctgatttgagtttattgagtgggagatatgactatacaagtctaaaattgatcttgcaaagtgggtaggctgataactgtcttttttattttttcctattttgttgatgtgaaaactgtggctcacagaggttgcttgaatgaccaaaatagaaaagagccagggagatatagggctggtcttgaacccaagatgactacattctttaatctcttcattatctgtccacctactagaaagtcatattggaagtgatggatgccagctccccaggcgttcctggcctccttaggattggatgtatccagaaactgactagtgagcagcgcttttaatattttaattaatcattaactggcttgccctctgagcactttttgctcctgctttgaatttttagacagatggcaggcggttatttcctcagctttgtcatctttcacatggcagatgaaatatcaagcacagacttggagaaggatcataattcattataattagtcttctttgatcatttgtcctttgtcctaagtacagtagcaacatttaattgtggctgaagcattagtcaagagcagtgagcaaaatgctctctctctctctgtcttctctcaatatatgcctgagggcaccactgatgttgggaaaccatattctcagttggctttttaaatagctatacagcagcaagtggaaggggcgttgtatttagaagccatgacatgaatatggcctattttccttgatcatgttagtattgttaattaacatactgaccatttagtactgttgtgaggatttaggaaggaaaggagctaactaacattaactgatggcctcctctgtgcttgataatttactgatatgctctcactacctcttcagaacatgtcaaggctggataactgggcaaagtcatgcagctaccacatggcagagaaccaacccctcaactgcctgaatccagaacctatgcatttgtacaagcttgtttatctgcactctcttgtagtgtatttacttaacaagccaagttagattgtaatcgaaagcaggtgctgtcatatcactgcatgaatcttgaaaagcatggctctgagaggtgacactgagagtggcagttgctggataatgtgttgttacaaattaacttcttgccctgccaattaaaaagcactttattgaataaagtaatgatgctcttttatgcctgttgtgtgatttagattttagtagtcaatataattgtatgacttagctttcagtctttacactcacttacccaagtcttatgaatcaggtggggaaatgaaattagttccattttacagatcagagaattgaggctcagttggtgccactgctattgaaggtcagctagcttttaaataatcagactgtagacatgtagattcatgtggcctctcctaaataagatccaagcagtagcaaaaatatgaagacttaggctcaggaaaattttttcttagaagctgacattcagctccaagtcatatggttagggtttgcttctttccacttttcaatttctgacactaagtgataattatagagactgagaagcaccgagtgcatttgctgaagctaattgactcgatggggggaaggctgattgtgcagcggaatccaaactaccaattaaagaagaaggaaatcacatgcacatgatatcttggatatttatatcttggggaactaaaagagccagccttccttgccaccgtggagacagtctgagagtcaaagtgcccggccctggggtggtcagcttgaggcctgggtttggccaagaccgcagccagcagcaccctggtcagcagcttctcagcccctaatgagtgctctggaggctgtgcttctaggctaaaatgggaaatcttggcaaaggaagagattagattcaatgcacaatgagagaggaaatcaggcaaataggagctgcatcaatcaattaattatcagaaaaagggggctcagaatacactaataatgctaacttgtgtacagtgctttggagtttacagagtatatggctctctcaacagcagccacttaagaagcaggagtgtttcccccagcttccagcaggcaagtgcatgccctgcttcccaaatctcctgggcaagaggagctaggccaggaatgcaggcttctgacttatggtcatagctgccgagggctgcctgcattgatgggtcctgggggtggtagtagggagtagacttggtgtggtttgtagctgattctcccaggaactggtttttgtttgtttgtttctaaattctatcttactgaagagcatccctacagtggcacaccagagtggctgcaaggctaacgataatggggctattaactaaataacggtgctggcacaaagaaacagccatgctaggatcttaattaggctctggctgaagcagagatggagcacatttgcaagagatttctggttgactaatctggtgtcaaattaagagtgttctctctgggttgtctcaagtcagtcaccgtatgacttaaaaagttgtctaaacgaagaattccaagtgggccaatttctcaggagaagagaggacttgcttccccaagagctagctccctggaatagattagcaccaggatccctttgtcttcgttgactaacagtttaactttacaggcttctcagctgggagtccactgtttctgtcccactaataagggctgaagtctgtccggctgtgtacctgggttactagagctgaaaagcacttggcagtcctggatgggctgtttatgagtagttcttctatctgcagcagcagttaaatggttctgggaaatgaatcaggatcaaaggggagcttgaggccagggcccagaacctgggctcttagggggtggggggcagcagaacagaacaaagtagtagggaaagcatgatgtcacacggaccttgtatctcacgtgacctctgctcttcccactggttgtggggtagagccatcatgttaattctgctgggcctttttcaatacctttaaaatgggcttattcatttctatgtcatgtaagagtcatgaagtttggatgaggttagagtttatgactctagccagggacacagtaaatactcagggaacagtcgttgcttctggatctatccagcttctttagaggcctgatgtctctatcaggatgtgccttgtgattgcccaggcactcatgcctgtttagattgaggtcccaaccctcctgacttcattggctctgcccagtggtgcactcccttgacctcctctattcttgccgtcacttccaggcacctgtgtctggcttttctcttcagtgaataattcaaatcctatcatcctctgactattcctcctcttctcctccaacctctgtctcttctacttggtacagcaactctgactgcccttggaataacaccctccccagctcaaccactgcctgccagagtcatgaactctagaagcagattccaccaggctttcttccccaaaaagaatatgcatcacaagaggcacttgagtagggagaggggatctctgaagcaatgccctaacccccttctttggctttttgatggattatgttgggtggaaatcaacttcaacatccatcttctagtggaagctgactcctctgattgccactagggagataggggcttaatgaaacagaattattggactaggaaagtataggccttgaaatcgacctgcttctaaaggtaaacaggtaggcagttcaggccaggaagctggaagaagactggtaaataagcaggatgctgcctgaagaacccatgcagaaaggtgatgaatggagatccagcaggcaggtggggtcagcgactctggaaataaggacacagcattaacggtcaggccagtacccaagaaattagacagacatgtgctgctgagaatagggtgaatggaagcagagtctagatcctcaggttaaataaacgatggtcacaggaggaacatggcatagcctggaaggaggggcacacacgatgaggaggtgaggacaggcaaggggaaggggaaggggtattatgctgggtttcaggatttggggccctagtaccctgaccaaaaaaaaaaaaaaacaaaacatattggccatacatttttaagcaggcgaaggcgggtggacagggatccacaaagagcttcaaggatgtgcaagctggtaattccacagactgactttgcagagattctatcaacttatttaaataggggaccgttattgaatttttacctgttccccagcagatagaatcaaatgagacagcatgtgaaggagccctgtaaacagtcaagcactgcactttattgacaagtttatcctttatagaactgctggtgttctgtgagcccattattgtactcactaaatattagctactcaaacatttgctattatgatgtggcagggaaaattgtgaagtattaatttacatttatgcatttcctcttgcccttatccaaaaaggtagcaggctctgggcttcctggcctgcaatacacttctgttcctcattttatctcttccacgctgccaaactcatggtgaatatttaagaggcagaggccctctcagggaaacaagtaaaaatgggatatgttttcctttgatctgaagacaatttgcagtcctggaaaaggaaggaaggattttgaatcctgctgaagagggaacttgtgctctattccctggtagcagaccaggaaggtggcctgctttcagagagagaagactgtgaatccacaccaaggggccccaggaccctaagctgctggacaggaagggaacaagaggacaggaatagtagggcactcactggtgacttgtgacgatggatgtcctgtgactgatgagctaaggcattcatgctaccaaacagctctgggccttctaccactctgagacttaggggcatggtagaggaagggatttaagctcagtcataagtatatttgattttctttcctccttggtagagaaggatatatcatattaaatttaacttgattttaaggaaacgagtaatatggcctttgtgcccatattcatgttgtgtgtgtgtgtatgtgtgtgtgtgtgtattttgaaggtcatatattttgcataactgttatatgatcacatatctcctaagggaaatggaaaacatttgcccagcacctgctatatatgcccctgtttctagcacatcactaaggcaatcaatttgagacttcagaataacctatgaagtattagtgtcctctttatatagataagaaactgagttaaataatgtttaagtgattctgcactaggataggtggttagtgttagaactaggatttaaacccaggtcatgtgatcccaaagctcaacctccctccaccacatcacgctggattccccaagaaggaggaggttagcagtgatgctcctcccttgcatgagaagggtgggcgcctatggcaggaggtttaataactatgaactgtgatataaaataattctcttgaatttatatggaagtgtcagacctttagaggaagtgtcagaccttcagagggggcactgctgagaggctgaatcattgaggtggatgagattacatatgagagaccttcaatgtgacccagatctgttttattttaaaaaacagttatcactgtcctcaccaccatctccctgctgaccaccacctttttaaatctcagcattgaggagagatttctatggatacattggcattgtccaggagacaggtgacacaaaaagacctgacagatttctcctaggcagagaattatgtgaggagggtgttgaattacatctaggaatagaatagtctgctggcgctgcagctacagggaaatgcctcactgaatatcagcaggcactttagatctattgcatctaatggaatcttcagtgtgatttaaagaagtagatattctgatttgattcctgttattttggtggtcatggggaaggatggggagtgatattgagaggagagagagagagaaagaaagggaaggagggaggaagggagaaagaaaaagaatctttgtatttaaatcagtgacaatgggagaaaaaaacaaacaacattcctgatttcttgctatcattgagcataaatatcattatttaactcttatagctcagaaagataagctcccagtcagctaggttttagcttctttgtgaaatgaatgagctcccctgaagctcatcacatgcattcctaaataagtttgtaagggaactacagttattcacttggcctgttgagttcttttcattttgcttttcgaaaatggttcttaagtgaaaagacacatgtttattgcctccttcattctttccctccccttttccctcccttccttccgctttccttcaatttccccctgcttcttttcctgctatgaacacttattgaatgcttgtgtttacaaagcgttgagacaagtacaagggagatagtaatggtcagacacaaagagctcctggtgcactctgtaaagaaacccagatctgtagaaagttaaagaaggacccatggagcaagaggcatatcaaacagaacttaaaggtgagtggcacttcaggagacagagatgcctcttagtggtggtggtggtggtggtcatggtggcgtggtgttgggggaaaggttctgatgaggaatgtgcatgagaaaactgacaaagacgtacagttcagggagtgatcatggctaggccatggtggctagaataggagtgggtatgcatggcatatcagggaccaattgtgaaggtggagagccagcctctgagtacctaggagccaagctattcctctgggtacctggccttgccgaagatttctgagtacataggaagcctggcctgcatgggcatgcagacatgagctctgtgtgtctgaatgcacattagtacaagatgtttacttgatgttgcatttcagattagatggtgaaaatgaatggatattatcattattatttccttctaattacttccttagttaaggtcaaaatagagccagagatgatcattttttcccttgcatctttgaatgtgcatgctaagaaacgcaatgtagtggcaagctaatcgctttcatcccatctcacctagtcaattgtacaaaaaacttgccgtgtttctacttttccagactgtagaagagggaagtgctgggggcctctgtgtgtgctgctgtcaggtgggagccctccctctggcctctttataacctgtttctgagatgcagagctcaaatccaatgccatgtcaaggcacactgtaaaagaagggctttgggtttctgagctcccgtctaaacagatctctatttattgggattaattgatcattaatatttgcagtaaagatatctttcagtgagagtcaagaaacttggtagaaatcgctgaggccttgaagccagatagaggtagatgaaagatctgtcctcactactcatgctgtgggtaacttcacacaagtggctgaaaccctctaggcttcaattttctcctctcttgagaatgtattataaggataatatgagacggaatgtgtaaaacacattataagtactcaataaaagagaacgataattatttaacagtgttagctacagggacagaaatcatggagagttcaatagtactttgttaagactggaaagattctgcaccctcacaatagagttcgtcagaggcccatgactgcctaatggcactttgcaaagaaagctgataagctggaggcaggttccagcagtgcccagaactcagccaggttaaacagcaatgctgtgtctcagtgacaaacctcagtgtcctctggcaatggtcacatttgctgttagctccagctctggttgctgtcctgcctgggttcagctcagcaatccttttgcccactgttgtttccagaaacaagtctcagctccatttcccagaaacagtccttagttgaagtgagagcttccaaccctgcctcctcaagctcccctgccctactcagccttatcagggacctctgtttatacagctaacctgccccattccccagtctgctgtccacacaattccctggttctcccaggggcctggttctgcggctgtctttcttttttgatggtccctgcacctctctgtgcaagagctgacagagactccaggctcctctgtggtcctcttgttgctggactttttccttagttcagctaaaaacgggatccttgtcacatgaccatgaaagattaggcacacagacacttcgaagggtgagaagggcaggctttattggatgaaaaggggaaaaagggaaatagtgactctcagcaaagcaagagtcctgcaagtagacttcctacctcacagattgaaacccatttgaccaccctggaactcgagaggccaggcgcctctcccctacaaacggtccgaacttcccacggctccaccccattctcccagtgtgcaggcctgttggaggctctctggggatctctttaaacttggctgtctcactctctgttacctggttgcctgctggctgtcaacccacctgaactattgagagatcatgggacattctgaaggcatttcttaatgttcctcctctggcccagtttaaatgacatcttctctgcaaactatattacataaagcttttttattttaacctataggcttactttttctcaaagaaaaattgtaacataacttcagggaaaattaaaactgaaagaattctattcgtaatcaaggtttgcgactgggcacggtggctcatgcctgtaatcccagcactttgggagcccgaggcaggcagatcacaagttcaagacctgcctggccaacatggtgaaaccccgtctctactaaaaatacaaaaatgtggcaggcacctataatcccagctactcctgaggctgaggcaggagaatcacttgaacccaggaggcagaggttgcagtgagctgagatggtgccattgcactccagcctgggctacaagagcaagactccatctcgaaaaaaaaaaaaatcaaggtttgtatatttcttaaagtttggagccaaattataattgattcattcagcaaataaccaagcatctactgtgagggactgtgtatgagccaagtaggataaattacttaatatgagtggatggtggagataaatcatacttgaaattgaaaaaaaaaaatactagaacaaatcctgtctcttgctcctatgtaaccataatcctttaatcttcaaattaaccatggtcaaattcttaatatcttttaccacctataaaaagattggtcagtctttgaaaaattaaacagacatttgggtcccagagcctggggcattgaacacattttattcgaaataggttttgtatggatgtgtgcctattccatgtagaagcagacatagcgagatggagatacagcaaggaagccccttaaaatacactagttcaatgatgagaaatgcactttctgcaaaaacagcttcacaggtatataagtgacagttcggagtcctttgattggtgtttttgaaaagagagattgagattaagagaatttgtgctgatttccaatagctcttctaccttaaaatattttttatgacagaggctacttattacaatattttcaaatgggttatcaagcatcgccgttttatggcaattccccttcgggtatccctgtccaaataatgtgcatttctacttgactaattcatttaggaggacaacagacacctcaggggagacatttaaagtctttcttcagaaggactcccatgtgtggtaatgagagcatgttttccccttttctttcttctcttccattatctcagataacaggaattaattagtgtcctacagtcttttactttaaactccactttaagagactcatctactaagtgactttgttgttttattattttgttttgatttttcttattcttgaaaacaccagggctgcttctagaatttcttgaataagccaagccaacaataggcacaatgctgccttttctgtgggtaaatacccactcttcactaagggaaggggtgtggtgcagacattgtaggaaagtggtgctcattttccttctgagctgatgcacagtgcctgctgcagtttctaaaaacagcctgctaacataacaatataccaacttcaggaaaattagtgtgggctttctgtgaacacacccagttgttgacacactttctaaagcaatcctgtgattgtacagtcatggtgctagacagtgtgatgtctgtgcgcaccagcttgcttttctgcagtgttcactctatcaagctaaaatggagtgcctattcagaaccacgcactgagctgtgtgttttagtgggtgaagaaaggaactgctctttgccctttagaaatttagagggtgactagagttataaagtaaggaagaaataaatggattatagaccaaatgcagccagcgtcatggagaggtatagtaaatgtattaggggtgacaaaaattgtttttcagtttaaaagagtcaacagactggtgtcagcaagatttcccccatggcaacatgaaaacaaacaaacaaaccaacaaacaaacaaaaccagcaactagaaacggactaaaataactttgtagggactcggaaattggcaaaggtatacagcaaccaaataaacacccaatcatggaaaagccacattcaaaatgatggggagctttgtggcattttcacttgccattgcccctttgccttcccagtgtcgttcagcacagtatgagggagttggtggcccagtcctcagctcccttcggtgaactgaagattgcagagaactgagtttgcaacatcctaacttgtcttcaggctgcttgaggtgtcactaactcagtgtataaaagagcaaaactagatttgaccgcagtctgaaggaagccatgggaagcagtggtgatgcctcatgaaaactgcaaggagctacaaacgtgaagacccctgagacaagagattgcctgctgaggaatacaattgaacagctaaggcccagaggagaagtaggggtgtgactcttagataaaataagacatttaaaaactatcatgtatatgaagaattgggggaaaaaatgatgcattcacaggaccaggaatatacatgttcagaacagtccctcaagccttaagagaggactttaaggctttatgtcataccgatgagtgaatgccttcttctgcatggactatgtgcagagactggagaggtgtctgtgtctgttttttgcaagtactctattttctatgagagatcagagatatacaaagaaatatgaatgcatggtccattcaaaggaaaaaacaaaatccccagaaatagtctctgaagaaatataggcactgagcttactagataaagacttttaaatagctgacttaaattttctcaaggagctaaagaaaaacatgaatggatgactaaaataaatcaggaatattatatatgaacaaaatgagaatatcaacaaagagataatatattttaaaaagaagtaaacaaattatggagctaaaacatacaataacaactgaaaatttcactagaagggttcaacagcagatttgaagaaacagaagaactaatcatagaacttgaagacaagtcatttgacattattgaatctgaaaaagaaaaaggaaaaatgaatgaagaaaagtgaatggagcctcagggatgtgtgggccattaccaaggggaccaatgtatgtactacaggagtccaagaaagagaagcaggagagaaagaggaagatatcttatttaaagaaataatgactgaaaacatactaaatttaggaaagaaatgaatatacaaatacaagaagctcagtgaactccaaataggataaattcagagagagtgtacctatattaagacaaattataataaaagtattgaattcaaagacaaagaaagcatcttgaaagcagcaagagaaaagccaggtatgataattccttctaagattatcagcatatttctcttgagaaacactgcaggccagagggcagcgggatggtgtatttaatgtgccgaaagaaaaaaaaaaggaagaaaaaaaacttatcaaccaagatcttaaatccacagcctagctttatactttaaaaacctcgaaaaacagcaagaaaaagctagcagaaagaaataacaaagattggagcagatagacacaaaatagagaacagaaaaagaatagaaaaaatatatataaatgaaacaatgagttggttcattgaaattttaaataaaattgaccaacctttagctagattaactatgattgagagaaaagactcaactaaattcagaaatgaaagagggaaaaatactaacaccaattttattgaaatacaaataattataagacagtattataaacaatataaccaacaaattggataatctaggggaaatggccaaattcctaaaaacatacaacctactaagactgaatcataaagacatagaaaatctgaatggacatataattatccaagacattgcatcagtaatgaaggagctcctgagaaagaaaagcccaggaacagatggcttcatgggtgaatagaatagaaagccaagaagtaaacttttacatatatggttaaatgcttttctacaaagataccaaaaccattaaatgagaaaataacagtcttttcaaaaaattatattggaaaaattggatattcacatgcaaaaaaattaagttagacccttatcttacactataaaacaattaactgaaagtggatcaaatacttaaatgtaaatttaaaatgctaaaaatattagaagaaatacaggggaaaagcttcatgacattggatctggcaatgatcttttggaaatgacatcaaagccataagcaacagcaacaagaaacataaattgaactacatcaaaattaaaaactttcatgcattaaagaatgttatcaatagagtgaaaaggcaacccatggaatgggagaaaacatttgaaaattacacatctgataagcagttaaggtccaaaatatatagagttcctacaacttgacaattaaaaaacaacttgatttaaaaaaagagcaaatgacttgaatagacatttctccaaagaaaatatccaaatggccaataagcacatgaaaagaaattcaacatcaacaatcactagggcaaggcaaatcaaaagcatgaaaacatagtccctcacagtcatgaggatggctaatatgaaaaacaaagcaaaacagacaaaacaacaaaacaaaaaacaagttttggtgagaatgtggagaaatgacatccttgtgcactgctggtaaggatgtaaaatggtgcagccactgtggaatagtatgtcagttcctcaaaaaattaaaaataaaactactttatgatccagcaatttcacttgtaggtatatactcgaaataattgaaagcagggacttcaagagatattgatacactcatgttcatagcagcagtattcataatagccaaaggtgaagtcaatccaagagtcctttgatggatgaatacatgaacaaaatatggtatatatacacaatggaatattgttcagccttaaaaaggaagaaaattcgaacacatgctacagcatgaatgcatcttgaagacattatgctaagtaaaacaaacctgtccaaaaaggtcaaatactgaatggctctccttatatgaggtaccaaaagtaatcaaattcatagagacaaagagtggaatgttggttgccaagggatgtgtatagagggaaatggggagttattgtttgacagttacagatattcagtttgggatgatgaaaaagttctggaaatgatactgataatggtcacacaacaatgtacttaataccactgaagagtatacttaaaaatggttaaataagaaatttaacataatgtatattatactacaataaaaaatagtaaagttttttgaaaagaatcaaaataagccttatggaataaatgtcatttgacacgtgagttccgagttcatccagttaattcatccagactttcccttttggaaaggatggatgacaagtctggcactacttctgggccagggtgaacagcagaatctgagtataaaaccacatgtgaactagtgctgcagaagctgatgttcaaaaaggtccataaaatcaaaagagaggccaagtgtggggattccatatggagaaccatgaggactgatggcaaagatccccagaatgcaccaggagaataagaaggagaacaagaacctcaactgtgacctgagacatgggaataccaaatccacacaaggagttaagggaggaaatgtcaagtagggtctcacgagcagagttgggttccagaagaaagaacatgaccaacgcagtgagatgagaaataggtttattgagatacataataataataatgccaacatagaccactaagggctttaatgtatatgagcacagggacccattaactggattgtattattatcccttttgccattggtaattttcctattatgtgtccgagcaagtatttgaacccaaagacctcagagcccatgcccttgaccacttatgctatagagagagaattagctgagtataacacaaaacatgaagtcatttgaatcacattttaaagggctgaccttcagatggtggcatttactgggccttgtggaaccttgatgttttttagcaggcaagagatgagaacagaaattactctgggaagacaatttggcaacacagaaatgaaataatttgatgaatgtcaaggctgaaattagggagatcagttagggaacatagaggaataaggcataaaccgaggggacaggaatggaatgtgtggactcaaaaacctttgaggaagttgaatcaagtggatttagctactaattagctgaacagtgccaagactccgggagagtctgcaatgactctgggacatctgaaactatggtgaggccaagtgtgcaatgatgtaagcagggataaggaaaacgggactactctgtggtggttggaattaattgtcagaaatccccaatcaaatcccctctgggatttgaagaatacatttttaagatgcataattagtctgaaagtaataacatgaatcctaaaatgcttacgaatccctttactaccatggatactaagctctttaatagggcacaagaacctctgttaactgggtgagatttaggagttcagcaatcacaagacagctccagctatttgagattatgctgagtgttggcttgtgtcactcttttttttttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatcggaaaggtggggaaaagattgagaaatccgatggcttgtgtcactcttgaaaattactttgaagtcttttagacttatcctattatatccttttatatgccacgccagttgaaacttggaaataattaaaaacaatagacaagaacctgctaatcttttatggtattcttctatttaggaaataattgattgggcgaagtggattacatttcaatattcagacaggctccttttgttattacttttgactctatctgctttttaaattaccttgcctattttgaaagcacagtacagttttcttatgtttctctttttggtgcaagacaatgtagaaaggctcatggtgtaaaggtgaaggatatccactatccaatttaatatccttacatgactaacatttttagagaaatagtcctttgaaattaataggaggtgatgtgacagtggaaaaaaatgtaaaaatcaatcagacttgattttcaatactggtgctggcacttaagagctttgggattttggaaattgaattaaataattgatcctcaatttctttgtctgaaatataggaataaaaatacctttaactcagggttattatgaggtttggtacatacgtatatttatatgtaactatatgtatacacacagacatacacatcacacctatagacagagaggaaggggggaagagaggatatgcacgcgtgtgtagtcttggcacatagtaaaaaaactggccgggcgcggtggctcatgcctgtaatcccagcaccttgggagacagaggtgggcggatcacctgaggtcaggagttggagggaaaaaaaaaaaaacagctgggcgtggtgatgcatgcctgtaatccccagctacttgggagtctgaggcaggagaatcgcttgaacccgggaggcagaggttgcggtgagccgaggtcgcgccattgcactccagcatggacaacaagagcaaaactctgtctcaaaaaaaaaaaaaaaaaaaaaagcccggcaccggggctcatgcctgtaatcccagcacgttgggaggccgaggcgggcggatcacgaggtcaggagattgagaccatcctggctaacatggtaaaactccgtctctactaaaaacacaaaaaaattagcggggcgtggtggtgggcgcctgcagtcccagctacttggaaggctgaggcaggagaatggcgtgaacctggagcgcggagtttgcagtgagccgagatggcgccactgcactccagcctgggctacagagcgagactgcgtctcaaaaacaaaaacaaaaacaaaaacaaacaaaaaaaccttaccatttaaaaaacgtgttctgtcctgccctaagaaagaatgcctaatgtttttgaggttcatctgctatgataaatgaaagaagccaaactcgaaagattgcgtattgcaggatttcattcataagaaaggtcaaaaattcacaaatttaattaggacacaaagtagattagtggttgtctaggattgggtagtggggttgataatggcaatttacaagtataaggtttattttctttttgcagtgggaaatatcttaacattagatttgtggtaatggttgcaccactctgtaaatgtactaataatcattgaattgcacacattcaacaggtgatgtttaagctatagtaattacatcaccaaaaagtcattttaaaataaaaaggatgatatttctgtatactaagctgactatcctaagtaaaataattggtgcttatgaaaaaaagaaacattatttgtgctttggggttaaggaagtctctcctgtatttgtctttaaatatttctttttgtgtgttgaccatttttttggtaataactccccaaatcagagtggtatatgagaatcattttctcatttacattacatattggcatctattcaggtctgtttgtgttttgccagccccactctgctctgattagctctggtccacacgtattcatacagcccgtgcatggcacatgcttattctcatggcacaagagaaaactaagccaaacctattagcacttaaagcttctgcacagatataccctgtttcatagctgcttccgtgtcattggctaacgcagctcacatggtcaagcctagtgctgatggaagtaaacttgcacttctaccatggagtgaggggattatgaatatttctgaacaataatacaatgagacaatctaccagtgttggaggacgatttggctaacatcctgacttgagcttaatcctctatcagtgcttcccatcccttctactctcttactatccaaagtatatctcatcttcctcttttcccactgggatttactgtaaacccttttctcctccaccatgaaaaactctgccaaggagcttgctgtcattcccagctaccatctcatgccttccatttcttgtactgccagacttcacaattatgaccaattggtgtccttactatttctctatcatacattgtttttatttctctatcatatttaactgcgttatgacttgaaacttctcaatccattggatttactctttctaaagcctctaatggccttagttgccaaatccatgacatttcttcagccattatttattttgatggtagtcatatttgtaccgtgaactcataaagtgcagcgtgtctgatcccccttatttgccaggttccacattcttctcccccacacttccttcctgtgtgatctggtatagtcccaggttttactttctgagagtgtgactcccatattaacatgtttatttctggctttcttaagtaagaaattaaagggtcaaaatgattactctatttaattaatcattcatttacatattaacattgctaatctgtttttgaacaggatggaaacagaaaacacttctctgggaaatttaaaggtaatcttaggtttaataattctattcataaatattactgtatgtagttgaaattagttcacaaattataaattacaattctaggccgggcacgatggctcacacctttaattttagcactttgggaggccgaggcaggcggatcacttgaggtcaggagttcaaaaccagcctggctaacatggtaaaaacgcatctctactaaaaacacaaaaaagtgagccaggcatggtggtgggtgcctgtaatcttagctactttggaggctgagacaggagaactgtttgaacccgggaggcagaagttgcagtgagctgagatcacgccactgcacttcaggctgggcagtagagtgagactccatctcaaaaagaaaaaattacaattctgtagtagaaatacagtattatgtttcgaagcacagcttagctcaatgcctgtatctagtgatttttctctccatttttaaaaccaaacatatacaaataggaaatattagggattatacgtgtagaattagatgtgctctgtgaaaaaaaaaatccacatgtagaattatgcaaaatacttgggcaaatgtaaatataccacaactgtttttattaaatcactatttttagttatcatgttgtctttatgagcattgagcacacttagtagaaaggctgccacactgtgtttagccttgtcatcctggaacaagatttttcatcttgaatagtctgataccaagactgaacccatctactgcaaagacctgtgttctgggaacgcaaagaatattctgacccccttttccagtattgagctgaaatcacaaagattttgtggtatagtgataagagctgtaagatttgggtttctattcctggcactaaccttggagtacggggacttgggagaggtgtggtgtagggaaacaggcaaggtcagtgctacacagagtgtgattcttggataggcaccatcaaagggaccacggagcttggtagaaatacgcatttctaggtttcacccagacccacccagacctgctatatcagagtcttagggttgagggccagccgcctattataaccagctatcttgatgtttcaagtgcttattaaagtttaggaagcacagggatagtcatctctacttaggcaatgaggttttgttaatcttcatagaggtgcaattatgggaggaaaatggtagtgagtaggagattgtggttgataatgatgtacctacaggattacagtgtgggggcaaatgagagagagtcataaatacagagtctgagtgaaccaaaatgagccttggagggagtaaatcttactgtagacaagcatcaagtttaccaaccagcacagatcctacaatcttgcaaggatgcaagaattttcttaaatgggttaacaagtaacttcagttcaaaaaattccaacattcaaagtttctgtccaggaaaggcagggcagatgggcccaaacagatgaaaaaaagtaatttgatgtgggggatttctaggaatatatgcactccctacttgtccatgcagaaccttattcagagaccagcctggcctttgctagagaactggacttcaaaattgaaagggactaacacaatgatgatgcttttattatggaaaagaaaacatgatttgcatacagagtcaggtgagtgcagtggtgactgggtctcccagatggaggccagctcttccttctgccctttaaagggtccagcaacttctgactttgagctctcaaagcagcttccttgcttggtcatctcaaactccgtggacctttgtagaactgagaaaataatctggctttcaaatggtaattcttgtatgttttcataaagatgttggtgatgatgacatgatgttgctgatgatgtaaagtaggcaatgctagtagtagatgtagtaggtgtttcccctctgtttaatgtagatggcttcccagaaaattgcaatgtagcttttcacatttcacacacaaacacacacacgccaggccctattccccttttaaaaaggttttcctctctgtcactaacggagatttcctagaatcacaacttgggttggaaaggagggacatcaccagttgctcaagtttagttcatgggaaataatctctggctaccccagcacctgagcgtcctggtggatttcatgactgtatgcattgctcttgatttgcctgctagtgtatgggcacaaacaagggtttggaatttagaaatggcaacaaatctgccttttaactcttatgactacttctaagaaaattaaagaaaatgctatatgcattagattttaatttgcttttcatattcagagaccatctggaaatgtaattatagttcaaacttttaatctccagtgcctagacaagctttttaaaattgtatttgaatctgtaaacagacacgctggttttttctataatggcttatttgttttgcaataaaacagtgtaatgatttaaaacagggtcgcatacctgcccattcccacctggactgacacttagaatctgggatacatatggatatttagtgaatgagccaaatccctgtttttcattcctgacttttaagtacactttgtgtactacagtgggtgagacgttaagtttcagaattaatctaagatggttctgaacccaggtatcaccacattttggctttgtgtccttggccaaaagatttaacctcactgagccttggtcttattttttgtaaaataggagattataatagctttgtccttgggtttgttctgaagactaaatgagatgatatatgtaaagaatttagtactgtgcctggcacaagtcaacaataacagttttgttgtcattactgttattgttttaaagttgtagctactatttattgttattttattttaaaaaattcttgtctgtttgtcccttacataagctatctttggcattaattacatctacaaattcccagttgtcacttgatctgatttgctttacttccaatcacagtggtccctgctctttagcatgcagggctacatttgtcagtgattaccttatgaaataccctggtgcaaagccagaatttaatatgaagatcttgtcaggagagctacattcctagtacagtcacaatgttggcaaagaatatagttggactagaggactttttagatctttccaggtctgagatctgggacttccagagtctctaatctccgtaaagagaacagtaatgtcttgtcccatttctgtatgcaagagtgatgtatgtgattctgccagctttttccagaatactcactactagtgactaacactttttagtgttaaccatctaaaagattgggaataatgtcagtttgcatacctataaagtaaaaatgataccatgggaagggtatgctgcagtatgaacaagataatatgtttatagcacccttcacaatacaccttgctccatgctagcacggttagacattgtctctggaatgctactgtgatacttgttcattacgaccccagtgtagggctcaggaacttaactacacaactgtgtccccactataaccctgctctaaccaaatagtcttacaagcctccaatgccctgactgaattcaaagatgagctgatttttagataaacttgcaaaggaatataaccttaaatgatctcctatttataatttataaaacacacttatacaaattgataatgatgtatgtttgaataattcaagaaacaggatgtcaatagattttagcaccaagtaccaagaaagcttctgcttgtgaatattaatttgactaatttgagatattaggccatctagtatggtaagcatatttgcagagtagtaggattttcgaagggtaatctaatcagaaatgggccaactagcatttgtaaaaaatgtaacaattacctgaagatctcatatgagatattttgcaactggcaaagagcaagataccctaagtaaaatgtaactgagcaccaaattaaatattgggaaaatgtctggaaagaatccatagtaagttgctttgttttgtactgtgctttcctcctatttatacaaatacatttatagatgagtatagacatttatagtctgagtagtttcatttatatgaccacaaaagtacaggcagcaaaagcaaaaaaaaataggctggtgaggcttctgtacagaaaaagaaacagttaagggagttaaaggattacctatggagcaggagaaaatattaactgctctatatctaataaggactcaatatctaaaaatgtaagaaacttctacaactcaataacaaaaaagtaataataacccaattaaaaaatggaagtggacttgaatagacatttcttcaaagaatgcatacaaatgtcccacagatacatgaaaaggtgttcaacatcactaatcgtcagggaaacgcaagtcaaaaccaaaatgaaatatcatctcacacttctgagcatggccattatcaaagaaacaaactagcagaaaataacaagtgttggagagaggatgtggagaaattggaacccttgtatattattggtgggactgtaaaatagtgcagctactactgaaaacagtatgaatgttcctcaaaaaactgaaaatcaaaataattgaaatcagtttttcaaagagatatttgtactcccatattcaatgaagcattattcatagtagtcaagaggtagaaaaagcctaaatgtccattggcaggtgaatggacaaagaaattgttgctcatgcctataatggatttttttttttttgagatggagtcttgctctgtcgcccaggctggagtgcagtggtgcaatcttggctcactgcaacctctgtctcccgggttgaagcaattcttctgcctcagcctcccaagtagctgggattacaggcatgtgccaccccacctggctaattttggtatttttagtagagaagggtttcaccatgttggcgaggctggtctcgaactcctgacctcgtgatctgcccacctcagcctcccaaagtgctgggattacaggcgtgagccaccacacccggccacaatggataccatgagatatcattcagccataagaatggaggaaattctgtcaaatgctataacatggatcaactttgagggcattatgttaagtgaaataagccagtcacagaaggacaaatgctatatgattccacttataggagatctctaaatcagccgaacccacagaagcagaaagtggaatggtacttgctagggcctgggaagggctgatcagagtatagagtttcagtcatgtaagttgtaaagttataaagatcttctgtaaaccattgtgcttatagttaacaatactgtactgaacacaaaagtttaagaggtttaacataatggttattatatatgtataatatatgtatatataatacactatatatatctattatatagatatatctattatatagatatatatataatttttcatcatcaatgtgctaaatcctgaggatacaaagaataaaagtatattttgctttgttcttgtaacataaacctatatataaataaacagaaattgtaagtcagtataaaagccagatacttcatcgtcctgcaagtatgtaaatgcattttaaaatgaacaccttagaaaggggattgtggattcagtttccagtgactaatttatgtctacattgggaggaatgtgtaagtctaatacacgctttctatcattgttttattttaatcctccacacaaacttgggtaacactattctgtgaaccacctgagggaccagctttgtaaccctgagtggaggttaatatatattaaaaaatagtgttataatgagtgcactccagtctccagaatccaggttaaacatgtcatcatgaccagaggccattgctaattttactttcatgtgaatctctttttaggcttcacatctagttgggattatttagaaatgaccaagactacaattattatacacagtttattagaaaaagaaaaggcatttgcctttatgttattgatttatttacttgtgttagttttaagaaaagacaaacagatcagatatagaaacacagcaatgctattttctatcaaattcctctgggtgtctcatgaaaatcttgcatattgaattttaaatccaattcgtgcagcccagaatgacatttcagtatattatgagttgtagtcaatatattgattacagtctctttgggcttacaatgattaaagaccatcacatggatacagtatttgtttagcagacaattctcaagattttcatgtgtgatacagaagccctaacaattatattgtatgtgtgccaaatgtttttcaaggctattgaaaataagaaaatttaattaaaatggtgtgaattcatttaaatttgtatggagagaatgggagatataattatgagcctgttcttggttgtttattgcatgaagttggctacttggtaatttcaagaccatggtaaaccagggttattttgaagtcatcaacaagtcatccttggaaagaacttccaattcttaagcaccttatacctgcctggtatgctaaacatacaaactcatttactcttcacagccatcttccacagaaatgttattatttccaaatgtggaaactgagacttctagaggacacgtagtttgccaaaggccacacaaatccagtagggctgaacttagaatgaggcctccaaaactgcaagtaaaatttaaataaatacaaaataacttactttgattaaatctggactacattgagaaagcccttgttttgtttttatcacacagctctcataaaattattattattttttaattgcaaagtatgctaagtacaaaatggtagctccaactttagtctgaataactacaatctccactgagggatttctttccaacaacagtgttccatggaagcagagatgacttttgtggtctcaagtggacttggccctcaaaggggaagctgcctctgagggtggggttattcactccaactctgggggctgtgaagccatctccagggatggcatgaccagttgggtcttgaatggagagttacataaaacctcaggaattaatgatttaataccatattctgtatttattttcttattttttcatgaagatcttcataccatagggtctcaaatatttaggaaaaaaaatgtttggattaaaccttctatcacattactcttgccttgaattgtgaatttttaaaaatgaaatttcagttgggatcacttttgtgtccagttacctaatatatatataggcctaatcaataataaacatgactactatttatgcataccaggtgctctgctaggagcttttgtttaattagcccagtacactcacacagcccatatgagactagtattgtaaaccacatatacagatgagataatgggggtttagaaaagctcattagcttgcctaaattcaccaactagtgtgattaaaattggatgtgaatgcagagctagttgattcggaaatgggtgctttaataatactattcagttcctatattttttaacatatccccacatagtgtattaacatgttcttagagatatatggagaaggaaaattcacctaaaaatctataccagggaacagttagcaatctttgtttaggttcatctgaagtttctgtaggcagttttctggaataagcttctctatggctggtattgcatcagcagcagtttcaatagggcagtctctgtgtctagagctcaagaaaatcagagcctgggtcatggtaggtaggcaaaggctgaggcagcaatgtcactcttaggagggaagcaataacctaagccaaataaatggtcatagtacaccctcaacctaaggtattgtcacaaacagggggctggagcctggattcattcatcaaagagcatgcctgttgattgtgcagaaggcatccattttagagaatttggatctttgagacatggtagagcaaacaaaacaaatgacatttatttcacacttgatatatgccagacattatgccaggcaattcatttgcacaactttattgtattcttatcaaaatctattgaaaaaagtattgttatctcatttcaagatgaagatgctaggacttaaaaaaaagtttttggatcaacattatacagctactaagcaagatactacgatataaaccctttctgtgcatctttccacagcccagtgctgttttcctggagattgctactgaaagtcattttcaacctcatacctggaaagatagggaagccaaggcacagagaagatgaatgatttctctgaggtcataaaactattaagtgccagaaccaggttttactgccagtctatttgatttcaaaattatttcaattagatcattgccatctctatgttaatatatcgttaatccttaagaaaactgtcatctgacccaaactcccacaccagcagccaacttgcttctttgcttctgttgctgcaaaactcttttaagatgtatctacactcaggttggcagttcctctacttctggcagccagttcctctacttctgttctcctaactttttcagattgcttttcccctctcatgctcatacagaagtcatccggatcccatactgctcaatcgatgaccaattcccagtcttgggtgatctatcagcaaggccatcttgcccttctattgggtaaactttgttcaaatggctcctagtgtcatatatactcagtctttctcctaccttgctgaacaccctttcttacttctctccaagctcttcacacaggagcatcttttttttgatgctcttgtctcttgctttctcctcatgactttggtgaatttatcccatgttcataactctatgtatcacctacatttcaacaacattaaaaattatagcttcagctgagacctgctttccaaactctagacttgtatttgcaaatgtctaccttatatccctatttggctgtctaacagatatttaagacaatatctccagtacttgattcctattcttccctcaaaacctgcttcaccagctgcctctctcatctcaagaatctgcatctttctcattattgctactgttaacacactgatccaaaccattatcatttcttgtctggattatttaaaataaataataaaaaactaaatatttaatgggatttcctacttcaaactcagttcatctagggtctgttttcaatatggcagccaatatggcagcgtgaccaaaatgtgtcccgttatgtcattcccattctcaaaaatgacctcaccatctgactcagaaacagttgaaacatttacaatggtcttcttctgagctcctctctctttctctacacccatcataccatcacattccagctgtaggatgttggctgtagaattttgcactggttgagttgccctatccccagatatcagctttaataactacctcatccttttcaagtctttgtccatgttttacactctcagtaatccctactctgaactatctaacgaagtaaactgcctgccatcttattttgtcctcctgattctgcctatgctgttcccataaaatatatatatatatatatatataaaataaagatgcatcgctttctaacactctagataatgtgtttatttagcatggatattgcttattgttggttttctcccctagaatgtaaataccacaagggcataaatttggtctttttaccactagtgtattttgagcacttaaaacagtgcctgagacataataggtcctcaaaaaatacttgttgaatgagataataaaagtaagtatattgcagaccttttttagccatcttaactttgcagaaatttaagtatctaatctgaagtatctgagggtacatttttcccctcataatctctgctatttaactagtgtctaatttcctaccaattagtctatgtaaatttatttcaggcttcatataaaccactgagcagctcaatgatattgatctttactgccatttaatggggttggtcagtgatcaactccaggcaagaccctgaatcagcttttacttatctgccctctggcatgtaaataagtggacaaatgtctgcaaactcatgagacccttcctcttttccttaaatgttgtcatatgcctatctgtgctctttctttggttagaaaaataaagggaatttaaaatctttggaataacaggaagaactagaatcattcataagtattttcttcaactttactctaattgccctaagattaatctcttgttacaacagcaaagtctagcctctctagaattccttgaacactgtatttcaataatttgatcctcatggacagtgaatctatctgtcacagtcagttgtcctttcactctttgaatcaattggcgtttacccatatcaaactctatttgtccatcacttctaaaactcttgataatttccaattgctcatggagctgagcttgaaggttgacatggatcatccattctttccagaatgacaaatagcattacatggtgatcctcacattttatcttaatttcttggcaaatgttaatttaattttctgctaaatggtttcaatctcatgcagaaccaaagtgaactaagttaactatctcagaaatatcccctgtcttgtcaggataattatttctttcatttaaatgaaaattaagtaacactctctggtgatttttttagatcatcaacataatttctgatgtcactgtgaacctctgagacacgttaagcttaaatttccccctaggctcaaagtggttatatgaatttacttgttcaaaagagattgcatagaaacctaacacaaactgacggcatcttggagctaaaagtagtcttaggtattatgaaacccagtcataacagagtttgcaagtagagaaactgaagctcagaaaggaaagttgaatgtataagttcacattgcaccaaattgggcagagacgaatagcaaaccttggtcttttgacttagtccaataaagctataaaattacatgcaaatgttggtgaatatttgcagaacatttgtttgagaaacgtgtccttagcaatttatcacaaaggtcagtgatctctctaatgttaggcaccaaggtccacttcactattttacagacacagttggcccagggtccatgtaaagttaatccaagaatccatgtaaaactaaattgagctttgtattcagttttaaacaatagtaacttctttcttactaatgagcatggatggattagttgggtatccctgctggggcattggattgctgtgacttcagtgctctctggaacaagcgcagtccaggtgcctgtgtgtggagaagataaaacacttgatgttcaggtttgtttttttttttaatttcaatttttattttaagttctgaggtacatgtctaggatgtgcaggtttgttacataggtaaatgtgtgccatggtggtttgctgcacctatcaacccatcacttaggtgttaagcccaggatacactagctatttttcctaatgctctccctaccctgacctaaccccctaacaggccccagttcgtgttgttcctctccctgtgtctatgtgttctcattgttcagctcctacttataagtgaggacatgcgatgtttggttttctgtttctgtgttagtttgctgaggataatggctttcagctccatccatgtccctgtaaaggacaagatcttgttcctttttatggctgcatagtattccatggtgtatatgtaccacattttctttatccagtctatcactgatggacatttgggttaattctgtgtctttgctgttgtgaatagtgctgcaatgaacatacatgtccatgtatctttgtaacagagtaatttatattcctctaggtatatacctagaagaaaatataggaaataccattcaggacatagggatgggcaaagatttcatgatgaaagtgccaaaagcaattgcagcaaaagcaaaaattgacaaatgggatctcattacattaagtagcttctgcacagcaaaagaaactatcatcagaggaaacaggcaacctacagagtgggagaccatttctgcattctattcatctgacaaacatctaatatccagaatctacacggaacttaaacttacaacaaaaaacagccccattaaaaagtgggcaaaagacatgaacaaacacttctcaaaagaagacactcatgaagccaataaacatatgacaaaaagttcaacatcactgattattagagaaatgcaaatcaaaaccacaatgaaataccatctcacaccagtcagaatggcgattattaaaaactcaaggtacaacacatgctggcaaagttgcagagaaataggaatgcttttacactattggagggaatgtaaattagttcaaccattgtggaagacagtgtggcgattcctcaaggatctagaaccagaaatatcatttgacccagcactcccattactgaagttcagtatttctaaacagagaagataattagttttttatcttctgttgacttctacctctcctccgcaaagatttcaattagtaaaaataaaagctaacacacacataggtaagaaaactcaaatacgatctccttttgcaaaatttttattatgagattttgaaataataggacgtgtgatgatatgtaaattccttccactatagcttttgaggttgtgtgtgtatgtgtaagtgcgaatgtgtgtgtgtgtgtgtgtatggatttgcgtgagaattagatattaacattaaaaaacttatttttccatcatatatcagaaaacatgatttttaataaatgtatcatctaatatgcaaagatgtattacaagaaaaaaattaatatgcctgctttgccactaaatccatcacccccaggcattctcattctcccttctaaagcccatttttcatctgtaagtgaaagaattgaactagtttgctaagaccctttgttaataatcagtgtgtatgtggtgacttgctactaaactcaaactgcaggtcacctccaccattttctgagacagaaattgtatgagcagtttttttgcgtgattgaaaataatatatgcatgtgagacattggcagctaagaacttggctattatatgcatatcagacaccgtgataggctgatcctactctttcttttttctttttttttttaatttttgagacagtgtcttgctctgtcacccaggctgcaatgcagtggcacgatctccactcactgcaacctccacctcccgggttcaagcaattctcctgcctcagcctcccgagtagctgagattacaggtgcgggccaccacacccagctaatttttgtatttttaatagagatggggtttcatcatgccaggctagtttcaaactcctgacctcgtgatctgcccgtctcggcctcccaaagtgctgggattacaggcgtgagccactgcgccaggccgatccctgctctttcttaatcatagctttgaacagttgtagtcccaaggctatccctcttatggttttaaagttgacccttctggcattataataagttatgcactctaggatttttcattgagaaaagactaagaattgattttaatctcagatcttacagttcagcaaacagctttttcctacttgattttttttttgtcccatatccctttcccatgcatttctcttttgctcttctctcccttccatttacccaactaggtctcacatctcagaatcagatgtaatagatttttgtgtttccacctagtactgttttcccagagtaatctgggaaagttgggcacgcctagcagacaacatagactttgtggaatatccttcttccacaacttaaagggtcttctttacaaaattacaaatctttacaaaattacagttaaaaggtcttagcagaagccctaagaaagtgggagcccaaagggtaagcctcatcaaattcctggtaaatccatatatgtccatctctgtctggctgtgtctacttttgtatgttccaatgttttagagtgcagacacacacacacacacacacacacacacacaaagatgcaaaatgctggtgtcctgccactttctctttggcagaatgtgagactaaaaacattctcagtgagttcttgcctaaagaatgtaggactattttgaaggctccagaggacaattaataagattttatttttctttttattagaatttacatttattgacgttcataaagaagctgataactgcttagaatatgaactcagatatggtctctctgacaagatgccctcctgcacaaaatgttggcattagcattatgcatgcaattgatgtgatatattcagaattactctgaaagaaaagaagaaaatgttaaggagactgatacattcaaacaattttaggtttgtaacatggttgttagcgataaaatttgaagaagaattaagggtgagagaaaaagtaattggcctccagtaaacacctctcactgccagtacaaggcaaggagacaaggtcagcattcatatttcataagcctagtaataacaccactgtaatctgcacagctactttggatgtgagatgatattctatttctgggggagtcagcttttctttatgtacagtatctctcttttcccatttaaaaattatttccattcattaaaaaagagataaaagaattacaaaactacctcccttgttcccagaactctctattgacatgattgtttatttctctttctgcctttaatgtctttataagtatttatttaacttatttgagaatatattgtctatgttttatcctgttttattctctttacatatttctatgctaacattcctcattgtaaacagcctttttgcagatgtttaccttaaatatcaaacaccaaatatcaaagtttactaaacttttcctcccattgttaaatatctagattaattccaaattttcttcattaaacatacattgccgtgaatattttctatctaatcagtttctttattttagattacattcttagaatatattcccagaagtagaattagagactccaaggatttgaatcttttaaaaagtgtttttaatacatggttccaaatctcataccaaatggaatacattgattttcatatttaatatctaaatttgtgaaatattctgctgaattaactttgatttttttcccgtcagtctttaattaaaagttgctgtctctctcagttacaggactagctaccagatttgaactgactgccagtcattctgggtaaaagcgtcaggtttttcttaactctgttgagtatatatcctattcaaaaaactgagttttttgtggggcaaataattagcatgaaatgcaagttggctctcttcatccttctcgttaaatcttgcataccatcttaaaatacttgaacttttctttttaatccataataggcaaaataaatactcaaattagcaaacaaaaatcaaaataacagtctttataaaagaatagtatttcaccatgattaacattttcatgtgtggtgcacacttatacaaaatgagtttttgaaaattttattattcccctgcagccctccagcccagaataatcaccattctactctctacttctcttcagcttttttagatttcacgtataagtaagatcataaaatatttgtctttctgtgtttggcttatttcactcagcataatgtcctccaaggtcatccatattgttacaaatggcagaatcttcttctttttaaaagctgaatagtactttagtgtgtgtgtatgtgtgtgtgtgtgtgcgcataaaatagaaccacactttcatgactcattcatccatcagtggacagttggatcatttccatatcttggttattgtgaataatgttacagtgaacatgtgggtacagcaatttcttccagatggtgatttcattttctttggatatatacccagaagtgagattgctggacaacatggtagttctattttcaatttttaggagcactcatactgctttttcataatggctataccagttctccccaccaacgatagacaagggttcctttttcttcacattctcaccaacacttgttgcctcttgtctttttcatgatagccatcctaacagttttgagatgatactgtggttttgatttgcatatctctgctgactagtgatgttgcacatcttttcctatatctgttgatcacttgtatgtattctttggaaaaaaatgtctgttcaggttctttgctcattttttaattgagttatttggtttttttttttctaatgacttgtgtcagtttttaaaatgtattagatattaatccttcatcagatatatggtttgcatatatattctcttattttatagcttatcttttcatttcattgattgtttgctgtgaaaaaaaatccatcattaaggggaaataaacaagggtgatttttttctcactttgtgttgatttttttttgagacataatttgagttgtacatcactaattagaattgagataaaaagatggaagaaagccacttccacagcacgttttatatgaactcgcaggaagcagaagtatgcagaagttagaagaggcaccttgagctcaaaatgaaaaaattctgtcttttaaacatcactgcttgtcttcatcagaaaccaaatgtgacttcttggtagggatgttgtaaaggggtttaccattggtgggtagatgaattccatgaatttaaaattgcttttcacctttgaaatttagtgagttcattacagctgggaggcagacctatgggattcataaatggctgagaagaaaaggacatgagattactaggagaaaatacactctgatggaagagagagtcactcccaaccgttggctcaggagtaagctttagttgtcgatgaagaggagtggtttagagaattgcctgttgcctgtcactcaatgttgcctcaacccaggtattcatatggcactgtgggggttcttgagaaagcataagcaaaaacttacagaatttttttcggtaaaatcctgtaagccattaaggtacacagtgtattatgcagtaaatttaggtcacccatttcatggcccacagctcagtttgggaagcttgtagactccagatgagactccagggcatcaacaagaaagcatgatgaaagcattgaccaagaaaggtggaaacatattgagtagcaggaaccaaagcccatttgaaaaggaaatgccattagacactggtggttctcagtggaaacacaaagatgccttgagaagaagagtctggcctagtgacaagtgaggagtactgaattcagctggaaaaagaattctcttttttaggcaaactccataccacttgaggcaaagagccaacatgtattccctacaatctgagctgtaactcagtttgcttttgttttttcaaacagttaaaaagagacttggctggtactttcaaaggggaaattgagataactaacaattttggagaaggaatattgcattttcaggttcatttactatgaatgcctaccaaagcaattacagacaaacctttctttctttcctagaagataataaaaatgataattagcaatctgctccttcatttcttcacatgttcttgaccttgccttgctatttagggcttaccatatacagatgatttttagaaagaatatgatttaatttcttttagaaattaaatttctaacatttagaagcttcgttttcttaaatataaatgttttttcaaatggtctcaaatggtctctaagcaaaaaataggacaatagaaaagacctctgttgctactgtttcttacattctgggaagttatataagctgaatatgtgtgaattgaatgatatatctttaaaatatttattggttaggtataagttataaatcacccataatagtttagttaaatttattttacttttatgattatatacagggcaaactagagactttgaggtgtgaaaaaccttcaggtaaattctcactccacggtgtacaggctaagcctcagcttgaaagttgtgataatctaacaaagagttcttgtgaaggttaaatagaatgaagactagaaaacatcttgtacaaaactctctgatttcaagtagccttcattgtgagtataaagctgagacaaatgaccttgaaaactatatatgaataagggctaaagtgtcagtccaggctgtagttgcttgagaaggacaagaaaataaggcagccatcagagcagtgaggacatattgaaaaaggagaggcatatgctagaacttggaggaggatagggatgtagtaggtcatctctgagcccctacataagtcctgaagtctctatttgatgcttagaatgaccattaccctgaaatcttacaattagcctcttagtttcttcctagggaacatttaatgattactggctccattaagtgttgcattaagccagaaattcagtgaaaccatattaatcacataaacgtaaaaaccagaattagcctctgagctactttgttcctcagtgtccccattgcatatacttggcaagtccacccaaacctatctctttaatatccatgggatccgtccatttctctccatgttaacttccatgactacatttaatactacctttttgtaggttgaattatttcagcagtttcaattgccatccttgcttccgctgcagtgcattgttcatacaaacagcagctagatcattctaacttgcatctgatctgctaaaatcctttcagtgggtctttagaatctttgtcctttggcaataaggaggaagcagtagaacaagcttgtgtctgttctaaacagtgactatgctgctttgggtaggaatcactggatttatagttggcctatactgaacttttggttctatgtgtctaaggggtactcatcttacatatgaaaaatgatctttccagttgaaaaatgatgttatgtataaacctgtggaaaaacatgagagtgtcctaaactcgggtatcaacaataagcctagtaaaatggtatcaagtttaaaggtctagatggtagatggttatttaatgagaggtaaggatggagtatgatttagatttataggtagacaattgggggtataatgtcgttaaataagatagggaaaagaatatgctgaactttgctaagagggaaaattaataaatttaatttgaacatattgtgtctgggatatctctacctccagatagaggggcttggttgtaggctattgttgcaaactatatggagctggtgagagggatccaagctggaggcagatttggaagagatcaggacattggtgatgtgagaaggaacagatgggaatgggtggaaatctaagcacggccaagtaagaaagaagtggactggagatagagctgccatctattgtccacactgtgcattcacctcctactatgaccctagtgcttctgcctatgtcctcccttaggatattttcagcaccgcaacaagagcaaaccttttaacatagaagttaggtcacctcactcccctgtctgaaacctgccaagggctccctgttacactcaggtcaaaagtcaacatactttcaaggttccgcaggccctccatgacctgccagccccttccccatgggctttctggtctcttattttaaactctcctggccccttcattccatggtcccttcgttccattcccaagtgttatctggcttacttatctgccaatataccggggagcctcttgccttagcccttctcagtggcaaggctattctctctaaaatattattttcccagaaagtaccatgtctttctctctttcctctctcagatctgtgcttaaaggttgaccatgcatcaagtgttggttgaccatattttagtaactcaattctctaaccaccaaaaatgggactttttagttctatgttctgctttatcttactccatagctgatattattaatatttttatcctgcatatttcattatttatttgcgcattgtctctcccaatcaaagtgttagcttaatgagggtaaggattgtgtctcttctgttcactgctgtgttcatgacaccccaaacactgcctggcacataacataggagccgctcagtgaatgattgctgaaggactgaatcaagatggggatgaatgaaatccgaagagatccagtgtcttaagtcataggcagcagagagagggttcatttgaatgctatgggtgagataagcatatgtcaagaaatatcttggcaggagttgacataactctgattgctttctctaaaaaaattagggttttttttgtttgtttttttgtgttttattagcaatctaaaagtctctagagtgagcttgccaggttctggagtcctgttcctcatgtactaacacacactgatgtgtgaatggtaggcttgtgtgaacctgttcaggtcagcagtatccttcccttgctctgatcattttagactcaataaaaaaatcagtttagcagcacaacttcccaggttttcttggtgtttgtgttttccctcagatacattgtaaaaggctttattgcaggggcaaagtactttccttcttctcataccttccagtgctaagcacctaaataaagagcaattgaaattttattaattaaatattaattgcatttttctgatatttcaatgaaaacttctaagaaaaggtgattatatttctatattttggcaagaacactggaaccgaagtcaggaaatataaactggagtctcctgtcacctactttttaagtgagtgactttcgaagagttacaaatttctttgtgcctcagtttcctcctatattaattgtaataattatcagtcctgccttaaatcacactagtatggaatttaacaaggtaatttaaaaattattttctataacataaaactttatgaatttcatttatataactgtctgtggagaaactacttttccctaggatttctttgtagatcctctgaatcagacaattctaggtcttagtatgtgaaatgcacatattttagatagtcgacttatttaaaatgttattctgtttctggatttgcattcttttgccttccaatttgatttgtctgatatgttgtgaagagtatatgactaaatgattataaggtatttctggagttattaaacggtgcttcttgtctcaatggaaataacagtttcattttgtagcttatccattttgactagaagaaagcccagaagtgaatcagggtgtgtctatattttgtacctcctaattgattttcaaaatgatataagtgaaacagaagcgaagggaagattgaaatttacaagctgtgtaaatatttccccatagaaataagcttatgaactttagaagagggtgagggagagatgcattttagaggcatgaccaaaatgaatactgaaagatcagacccacatggactgaatcattagcttggagatctcaggaaaatctggtgagtagaatcttctgagagaaggaactttggtagtagaaagtagggtgtaaatccactgatttcaagaagatgtaagagttttacctccacttggtaaggcatgtatatctgaagtcagtttctgtctgctatggactgacttgaggattgactactcaatcaacatatatctataaaatatcatgcactaggcaaattgtgggcactgtggtgaagaaagcttatgacagtagatctcacggggccctcaatctatttagaaaggtagtttccaggccaataatttaaatagtttttgagtgtagggcagaacactgtgggatactacaactttggccagtaaggacacctaacctggtttggaagctcaggaaagattatatcaaacccagtactaaacatttaatatcccaaattccagggtttacacaacctcatacacagtcatactacttatgagaccagtgctttcatttgcatgcagtcaagctatggaatgttgttcagtcactacacttcatgcttttgaactaatgtagtggggtgtactttaaaggaggcagacggcctggacaacagctgtgtataaggtaatctttgaatgtcatctgttaaatggaaaaaaaatgccactcttacttctcagtttgctctgaatatgcactgaaatactgcctgtagaagatgaaccaaagctgacacttattaatgttaggtctgattttctgagccattgattgtgacattatagtaagctcttgtctgtggatttggtttgtggtcttgattcaccttgcagaagggacgggtttctataactctgtgcccttcatgaatgatcagtcagatgccttctaatggggcactcattgagtactgtcttgtgtttgcagcctgaatgttcttgtgttgggaagagccataccagaatctttcagataaagcaatgggacacattgtcatgtatcacactgttatcaacacatctataagtggcccttttcctcagcatagcattttttttcctgggtattatggatgagtttcccatgctgtggtgtagccaaagttgtcctattaaggaaagtcacagcactttggatggtaaggcatgataatgcaattctgaaggggattcttaatgtacggatgatcaaaaggtgaccctaagggcaaattgataattgtgggaagcccagtgcttcccaccagtgtacagagataggttaatttatatttccccacaggtgtttgtctgatagactaatgatgttaagcagaataacaaaatctgcatttaaatgaatgtattataatgtggaaaagtaagcccaaatacaaagtaagcgccatcacgtttgggataaaaacaaagtacagtatcattagagtcctctgggaaaacgtttgtctgtgatttatggtcttattttggagcggctcttatagaccctcctggaacccagctaatgaataaatgataattctacccctctatacatcacacttttttttacttttttttttgttactacagcataaacacacattcccattagattaatgtttctaataaattaggaaaaatgctaagtaagaaagaaagggaaccaaaatggaaaattcagtgaagtacagactctatgggccaagagataatttacttttattagttttttctttaagaccatagtgaaagtaatgatctagctatttttattttaaatattgcacagataattttggaatcgaaagtggaaccaattatttaaagtcctaccctcgtcttccctgagacttaaatagaaacagtagggaaatgcaaagtatttaactggtatgaaactgagagcaactaatcagaaagaatgtcaggcataatacaagagtagaaagaatcctagctgttcactgatgtgccatgtgttaactctttagtctttgaatagcgggaagatctgaggacctagagaaagggccagagtagccacaggggtggtcatgtggcatccagagaacctgtagctatttaccaactgattgagaagtatttcagtgttttaacaactggtatcactgtacatgccagtggactgtgagccctgaagagatagaccattgagttctattttcttgtcaaattgggccacaggaagtctcaggctcattgagatctagttagggctctgtcactcactagctgttgacgtttgtgtaagtcagtgcacaatcaccccagtccctttctccccctttgcagtgatatggagctactactacctacttggtaaggctggtagatgcatatgactagataattgcatgggatactgcaatgcaaagtctgaagcatgatacctgtctaactgtggagaacccctgattttgctttgtccgggattctttttccaacctcactttgaagaacccctgaaggcactgaacatctagatatcctacatcctgtggccaaggggcaggcagaaaacctaagctcatgcaaatttatactatctcctaacaattgtatttttaagaagagtgctacaaggatttttaatggttaaaatttatttatcttgagacaagtgccattaagagactgtgcaagggccaggcgcgtggctcacgcctgtaatcccagcactttgggaggccgaggcaggcggaccacaatgtcaggagactgagaccatcctggctaacacggaaaaaccccttctctactaaaaatgcaaaaaaactagcgaggcatggtggcacgtgcctgtaaccccagctactcgggagactgaggcaagagaatcacttgaacgtgggaggcagaggttgcagtgagtcgagattgcgccactgcactccagcctaagccatagagcgagactctgtctcaaacaaagaacaacaacaaaacaagagactttgcgaggaatgttgcaagctgtcccagtgctgccttgatgcctcttcagacaaggtactccaacttttcctttgattccttataagtaatttcttccaacaagttactcttttgcttaaatctgacacatcaagttttgttgcctgcagtcacagaaactttttgtagagaagtggccccttagttttcaaagaaacacaaatgccactgcttggggctttcctctatctgcttggaatttcttcttccttccctctctcccttcctccttttcctctcttactccctcttttcctgcctacctacctttcctctttctgtctcctgtctttctgttttcaattgtgatatgtagaatcaattctgcatcttctaaataaatcagctgtggagcaggcttccagtttcatggaatttacatgtttgaggaacagatttgagaaagcagtctaacaattttttatgcattacactataaaccaggaaatgtatccagaatgaactagttactcacataaattaattcttaggtaaagctcacatgctatggaatggtttacctgactgaatgatgtctattcctaaggaagtaattttcctgattgtagctgtgatcacgtctcagggttttcacacagcatctcaggtggttctgtctcctgaccaatttcactgcctttgtgtgattatcagtgaagttacacagcagtacaggtaagatatgctgtaaggactgctgttcatgtcaaaatgtaatcgtgaggtgaaaattgtgttcagaacaatgctgtcccaggcctattaaggacaaaggagaatgaaagagcaatgtgctgtcataaaaccttgtataatgatttcaagccatgctgggccctgacagctgagggaggaacaggaattgagttgggaccatgcttcctaaacttatgcagctaatttagtagtagggatgttgtctctcccatgatgggttcgcagtgtaaagctccatgcctgagggagttggtacaatgtgggcatgggttgatttctagcagtacaataaagagagagaagtgaggtgagaagaggaagcttatgggcatgttaggccctgcctgggaggttttggaaataaaaaaataaaaacttcattctgagaaggaaaagagtaatacaagccttggtgcaggctttgcctccaagcctgaagggaacaggtgtgaaaaacctatatccagtccactagaatagccctgcaatgaagacacaaagcctgtagctggagtgtgtctgtggatgccacatctgactctgctaaacacagcagacccaagggtgggaggccactgaccatcctatctcagtgtctgacctggcagttttgagcctctgggtggctactgggacaggctggagaaggtagtgacctcaggtgcagtatttgggactaggtttctgaaagctacttgtgtattctagaaacatgcctgtttctcctctgtgcagaaaatagcccctaaggaaggggaacatatacatagagaagtagtgactgtttgaattaatcaatttatttattatttgtctgtttctctgctgactgcagacagaaaaaataaaatacagtggaagatcagataagggcaactcacactgtgacaaaggattttactatggaaaacattgtcaaatcatggtaccttgcctatccaatagcatttctctaataaaatattttctcaagaaggttattttgcaccaattaaacataaggctttgtcattaaatgttccaaagtttaaattgagttcctgtgggttgtatgtgcatttagtagtctgactgctttcccacaagaaatcaatatttctctaagatttgtgggaatatactattcattccaatagagacgattaaaatgttaacatgtaacaaactgcaaatctggcatggaatgcattgttttcatacatgcgtttagaacagaaactcagattggccattgtttatggggagttagagtatatcagacatgacaaatgtgttattctccccagataaatgtattttagcctgttgacaccaaaatgctcagggacctcaagttaagactgaaggtgaaaaagaaatacaatggtggaagttaaaacatcaccatcctaaaaacaactgtagtaaaattaaaattctgaaaataggcaacagcaatgaaaacaccaaaaatccagagacaatcaatatccaaaataataactacaaaccattgaaagcaaatcctcaaaagtatgtttgaggttcatggaaaagactactttttagactccacaaaggttggtggacttgaagttgtgcacagatctgcatttagtgttgtttgccacttcttccttaaattttctgctgacttgaattcaaagcatagactttatcgttcagactggtttttgtttttctagatcaactgttgaaccaagtgggatgctggaacgataagcataaactggaactcttccaggcaaatcagtataatagtcaccctaatgatgacccattcctgggtccttctctcatgaccattccttgtcagtctccctgcctgtgaatttcactttcgtccacacttcaaatgtagagtttatcaggggttccatttttcttcatctttgggagtgacagagttttcctagtgatcttatacacttacaacttaactccctaccttgtttctcatgacattcaaagacataactttatctcttaatctatagacccacatgtttactaattactatcacagagttttccataaatagctccaggtgaacattcctaaacccaaactcattctccatatcccccaaactcccctccctcctctgtcttctgtcttggttttcaccgtctaactagttttcttctccttgccatacttctactctgcaatcaatgacaacagaaacagacttttcttattttattttaagttcaggggtacatgttcaggtttgttatgtaggtagactcatgttgtaggggtttgttatacagattgttttgttacccaggtgtgaaaagtgttgacttagagcatattttgagaaaattattatgcaaaaagtatctaggtctacattttctgatgtgagttacattacaagagaacctcttcagtaaccacagcttgctataatttcatgttagaaaaagcaccatattacaaggataagacatgggcacaagccagtcagaatgcatgcctcaacaaatcaccataaagcctggccctaaacaatcagtaagcacttatgatgtataacagctaaatatcatttttgaaattaagtaagactcatggctcagaaggggaactaggggagtggcaagactccaggacaccactgtgttcccccactaactggttcttccatttttgtcactgatttacatgtgataaaatacacataggattattgaattcctgactgcataattacgactggtattttcaaagccaacagaataaaagtgttcaacctgacctataggatccattatggtcaacctcctgtcacctttcttagctcatatgctgacactctccacaacctctgtccctaccattctgtactgtgcatttgcttttcctccaacagaagaaaatgggccccatttttccggggcctttctactcctgttttctcgcagacaaggttacttctccctgcacttccctccctgtgctgcttaccaactacccctgaccaagtatcccctttgtgatctagtggattctaactcatccttcaagtctcagctcaaatataccattttcagtgaaatatttatttataccaaactcctccatacctctagaagattaatcatttgcttcccttggtctctgtacatccctctctgctagccctcaacataccacattccaatgatatctatttcacacactatccccagagactgagcttccagaggcagatactaatcttatcattgtttccatcgtgcatctagttaggtctcaatgggtatttgttagataaatttcaaattcccacaagtgtgatgctgacaggtcataagcgcaggccccttccatggaagaagggctctgctggtgaaacatggaccatccctgtgcagacattcagcagaaagtctatgcacactctttcttattttgatggtttcagtccaggtcttgccaggcaacagatgatattcccagatggtacttttggagagactttcccatagggattatttacccaagtatggatagagttaaaagaaccatcaagaaatgctactccattagaacggaaggaacaaggggcagaatggttatacccaaggtccagttgagaataggagtcatgaaagagagatataagatgaagtaggctaaggatattgagttctcttcccttttatctccgtatccttgatcctttcttttttctttctgctacttccctttcaccatttgccaccagaagctgccagagggcaaggaaatccaggcaatgcatcccattgagatcggctccttgggtacagagcagggtggaaaagaacagaaaataaataaagggtaaagacaggacagggacctaaacaggattgttcaatcttgaatgcctggcacttccaagaggcccaggacacatagaaaagaaatatttattacatgagtgaatggatataagtaggagcaagtctcctgaccctcacttattccaaagactttttcatttcaacatttctgcatgttagcctgttgcaaaaccacaaatctgctgccaaaaggtaaggctggatgtttggttctcttatgaacaggagaagactggcctataactgtggacacaagggaaagcattttctgacattcagatcatttggaagcatataaaagttaaatctgttctacattgtgttggaaagaaagaaaaaataaacaaacaaacaagcacaacaacaacaaatcacagagaggaaggaaaaaaaagaaaactgatgtgctgtgtccccaatttgtgcacgattctctgcagtggttcaagtttatcccagcttatcacttaaaatcaatgacctattttcttacccttgcctacgtattctctgtatgatgcactttgaaaagtgttgctcctcacacaaacaatatcaaaagccacctgggtgagttgtcactccttgttactcatccccgctgggcaccttcgggaaatgagggtgaatttgaggaggattcagagctggtgaacaagtcccacagagatgtggtggggaagagtggcaccagatagcacagaagctggccattttatttctcatcaaaagagcaggaaataatatagtcaataagaagcaggaaggagccaggggattttgtgaataaacaccagagtcactggaagaaaggacagaacaaatccttcacgtagccttggatgtccttgttctgccctgtagtgaacaagggaaaggggaagagtgtgatgaatagatcatgtcaggaaactatcagacacctcagcttctctcgtgtctactttatctcccagtttagagaaaaaaaaaaaagatttccttcaacttttcattgtaagctattgtttgggcttataacaggcatattcaaattgcagatggaaatgatttcagaaactgtattgttctttttgttatttattgtttcatttttaagaccagaaaaagcacacctcttagagagtgtgcctatattctccaatgaatatcgaagataattttctggtatattttctgataaataaaacaatataataaggtagttgctgatatgtgcatgcaaagctgaagtttattgttcttacttttctacattttgagcttattataaaatctatgaaactttcaaatatgtgtaaatatataaaatatacatatatagactatatatataatgaatatacatatacacattccatacacgtataatttatttttatttatcttttatttttttttattttttgagatggagtttcactctgttgcccaggctggagtgcagtggtgtgatcttggctcattgcaacctctgcctcctgggttcaagtgattctcctacctcagcctcccaagtagctgagattataggcatatgccaccacgcttggctaatttttgtatttttagtagagatggggtctcaccatgttggccaaactggtcttgaactcctggccttggcctcccaaagtgctggaattacaggtatgggccaccgcgccctgccatacatgtatattttaaaggttaataacaaaaccccaacctgcccaaggcctacttaaagtacgctctcagtaagtttcagcacttttatgtcactccttcattgcatgctattctgatctccgccagagtgaattttcggtagatttttttccttgcttctctttttagctttatcatatatgtaagtataagaaacatttaattttatagttttgtgtttttttgactcctatataaatgaaactgtagtatattcctttgtaaacttgtccttttagttcaatatcatttttttaaaattcattcacaaagataccaataattgtatttcttcattatcactattttataatattccactgcatgggtatgccacatattttttcctttttattttaatttctgggatacatgtgcaggacgtgcaggtttgttacataggtaaatgtgtgccatggtggtttgctgcacctatcaaccggtcacctagatgttaagcccagcatgcattagctatctatcctgatgctctccctcctcccacaaccctcgacatgccccagtgtgtgttgttcccctccctatgtccatatgttctcattgttcagctctcacttgtaagtgagaacatgcagtatttgattttctgtttctgcattagtttgctgaggataatggcttccagctccaaccacatccctgcaaaggacatgacttcattcctttttatggctgcatagtatttcaaggtgtacatgtaccacattttctttatccaatctatcattgatgggcatttaggttgactccatgtctttgctattgtgaataatgctgcactgaatatatgcgtgcatgtatctgtataacagaataatttatattcctatgggtttatacaataataggattcctgggtcaaatgttatttctgctctttaaggagtctccacactgtctttccaatggttgaactgacttacattcccatcaagagcgtaaaaagcattttattttcctggccaacatggcgaaaccctgtttctataaaaacacaaaaattagctgggtgtggtggcacacacctgtagtcccagctaattgggagactgaagcaggagaatcacttgaacccagaaggtggaggttgcagtgggccgaaattgagccactgcactccagcctgggcaatagaatgagactctgtctcaaaacaaaaaagtaaaataaaataaaaatagttttcctatttctccacagccttgccagcatctgtggtttcttgactttttaataatcatcattctgactggcatgagatgagatggcatctcattgtggttttgatttgaatttccctaatcatcaataatgttgacctttttttcatatgtttgttggccgcatgtctgtcttcttttgagaagtgtctgttcatgtcctttgcccactttttaaatgaggttgtttgttttttcctgtaatttgtttaagttccttgtagattctggatattagacctttgttaaatggacagatggcaaaattatttttcccattctgtaggttgtctcttcactctgataataatttcttttgctgtgcagaatctctttagtttaacaggctccatttgtaaatttttgcccttgttgcaattgcttttgacatttctgtcatgaagtctttgcccatctatgtcttgaatggtattgcctagattttcttctagggtttttgtagttttgagttttaaatgtaagcctttaatccatcttcagttaatttttgtatgaggtgtgaggaagatgtccagtttcaattttctgcatgtggctagccagttctcctagcaccaattataaatagggactattttccctattgcttgttttcatcaggtttgtcaaagatcaaatcgttgtagatgtgcggtcttgtgtctgagatttatattctgttccattggtctatctgtctgtttctgtaccagtactatgctggttttttttgtttgttgtttgtttgtttttgtttttgtttttacagtagccttgtatagcttgaagttgggtagtttgatacctccagttttattctttttgctgaggcataccttggctataagggctctttttcgtttccatatgaattttaaagtagttttttctaattatgtgaagaacttcaatggtagtttaatgggaatagcattatatctataaattactttgggtagtatggccattttcacaaggatatggcacaaattgttgatatattctagtggatacttgtgttgtttccagttttgttattgtttttctttttgccgtgttaaatgagaccactagaatataaccactggatcacagaatgttcatctatgtcttcctaaggtaatgccaagttgttttccaaagataataatacaagcttccactctagctgccagggtgtgagggcctctgctgctccacatatgctaatatgaggcagcacatgggattgtcagactccctgatttttgctagtctgttggagatttagtggtatctcaatgtgattttatttatatttacttgaaaactatatgatgtaagtttccagttgtgtctaatttcaaaagaaaaaaacaaacaatgtaacagaacaaaacaaaagcaaacaatataacaaccaaatggcaacaacaacacgcacaaaataaacacccaaggaaccttatttaaattatcattcttgagccaatgagtaatttactgtttttgttttaatgtatgctctatcttcatctgttaggagattacctcactatacagacagattctccatacagatcaacctaacagtaagaaatgtgtgtgtttggcacagtgccttgggaagaagagctgctatgtgtcattgatgactctattgtttcaccagttttcctttagttactatacaaatgggaacaaggatgggaattagggaaattttccaagtgtaagaagctttcagatcttctcacatcacttattggatatgcagtgacacattagacctttattttgtataaaagttgtctgttccttctcttgcttctccttcttccaaattgttgacctgcatacaacatcaataacaaacccattaaacaatttttaagccaatttagtagccaccacttccaggtcactaccaccataccattttgaaagtggctccacacagggcttcttctggaagtttatagtatccccattcagggccaactgtgcaccttctgcagaatgagatggggttccccaacttttgtgtatgttttttaatcctctcttattctgggatgttaggccctgaaaggacacaggaacagggctgatcatgcgtgctttcagggcccaaacatccaagacagtttgtaccaggataaccccaatagttgttaaaatattgaagcattcccatgcaggttggtcaataagcaattgtctcagaacttgtatggccaatcacaatgggaagcctctaagactcttttgtagcagcatagattggtgtctattttgaatggttggaacattgtgtgtgtgtgtgtgtgtatgtgtgtgtatgtgcatgcacctgagttagtggaagtaaagtaaggggaagagaggaggcaatgaggtttgtctatgacattctcactctcccaggttgcttcttttctttacaaaatccagagcagaccactttcaattttgctttacttccctttccatctatctaggacttactgcagcagacctccaggttttgtatctttactttctcccaagatcagcctcatgaccagactttgatggttggtggagtaataaggggagtccaatcaaccaatatactaagtataaggaactgaactgggagccatttcaaaaatgtatctatcatccacacacacacaaataatgcataatgaccttttgggtagattttaatgaaggaaaatgtaaatcctcaatgcaggttgcaaaaaatgaggatgtcaaagtaacccataataatgcctcttgtattattcatggtctttgatgaaagattttttaataaacaatttcacctttatcaaccaaatttaattacatttgtaccaggataattctttacttgtttggcttagaaatgacaaagcttctttccagattcattatgtatttttaggatttttcaagaaatcaggaagtaagagttattttcaaatgcttttacaagggtgaccaagaggccagtgttactggaaaggaaaaatatatgatgtcaaactcaacccactgaatgccaaaaataagaaggtattcattactgaacccagttttattggcagggaaaaatgcaattgaaaataccaatcaccagtaaagcatatatgaaacaatgctctttcgtagtcattttgcatttaacaagtttttaatttttttaaaaaaatgggaatacataagatgcttcctatgcaaataaatttcatgaatttcagtgaaaatactttgttttcatcccaggttcaccacactctttctatctgacagatttttttttcaacagaatatgggagtgattttgtccagttattcttctaggtctccgtggaaatttctttcttttatagataccatctggcctaatgagattctaacagttctatacacactctgtctttctttgtatttgcattttttcactggagtcattgctggtagtgaaatggaaaaataaggggaaaaaagtatgtatgttaaataagcatggcagttttctctgtcatttaagaaaagtaattacaattattcgtttgatttactgaatgtaagtattcagtttgaacactgtccaaaggatgttgccttacttaaatatccagtgatcctaaactaaaattgcggctgtagtcactgatgggtttagtctaggaatatataatcttgtgtgtcttcaaaatgttaggaagaaatcttcttaagcaggatttcattatgtgttttcaatcactaatcttcactccttgtctctctctctctctcaccccgcccccccgtgtgtgtttgtgtgtgtgtgtgtgtgtgtgtgcatgtgtgtgtgtgtgtgtgtgtgtgtctgtatgtttctgtctgtagaattaggtggagggttggtaagaataaatacaatcctacactgagatgtagaggtagcaagccaaatttgaggtaattatgctaggactcacattgttagcttccttgttcaccaaatgtacaaatttagctcataatcaatatttttaatgcaaaagtttatataaggtccatactgggtaaggaaaagaaaaaataacattaaacagggacttacatcctgacaacttttgtctcatgcatcagggactctgtcctatgggatagatctacgcgtatttggggaaacacattggccagtggtccaaagtggagggtagctctgggataagaaaggctttagattcatttttcaactcttacatttactgttgacataggacatgtttcttaaactttactagcctgtaaaatcagtggagtagacaagaggagataaagtacctaaaagtgtacctagcacataggaaacaataaaaattatccaattgtgttttaagaacctattttgactatacagctatgtactttgaagtcaaagttgtttacatgtgagaaaggaaatggaccaacagaataattatagatggcaacatcctttgcctaatgaatcatttgttaaaatacattcatctaccatgtgtcagaggctggtgctgaggctatgtaagttaccaaaggaggcgaaatccatgctaccgtggagctttcaatctaacaattaatgataagcagatcacaacatggcagaatagtagatacattagaaaaaagtgtctgctcccccctacacacatattagtcatttgtaaatgtttagaatgataaacattaaaagttacattttctttaaaaatattttatttggccttacacatggaagtaattttctctggctaggcttgtatttttattatgatatgtgaagcagttaacataactcatattaacactggctggaggttttatcttcaagggcagctggtgacagggccattaaggtccacagagagaggtggaaggaagggtggtctgaatgggcaatttctcatttgttggattgatccttgattttatcagcatgctcacgttcaaaaaatcccattgtgaggtataatagatgacacctgatactaaaaatctacctaccagcctgaacagttcagaaattaatgcctctcataacaccaagagatttgataatgaagccagctcagtagaggtcaaggggaaatgatattatgtgtgttcccctatgaatcaatgtaatcctattgcatttccccagatgttcacccctggcctgtgcagctacaatgtgatctcaaagactttcataggaatcctactaaacaattttgtctaaacttgaggcactgaaaaactgtgtatggtgtaacaggtggagtttacatggcaggttcctttgtccctggagatctgatcaaatggatcctcatcccatgctccttgattgtccggagtacttccaagtgttcagagagttcttaggagaatctatagtctcatggtcacttttggttctactttatcctctaaatttgagttaccttgccattctgtgaaaggtttctctgttcttcattgccttgacccagatgtgaaatttcatcacctgctcaatttccacacctcccaaccaaccttaaaagtcatttgaatatagcagattgttctgaaaatttagcaatgtaggcgttatggggtggaggtaagggcagagccttatgtgatgacaacacaaacaccatcacatttatttaaaccatgactttctttaaattccctttccctttccttcataggaacactccaccagcagcttcttcagtttatgtcctcagtacccagcctggtcccatctctcttctgggctctgttttgtgtattcaagcatatcagtatgctttgaagaacaaaaggaccttgcttaacacaatcctcctgctcagaagaaatatgtggttttaaataattttgttattattttaacatggcaaaaattcttgggcatgctggagtgtcaggtccatgggggagaaagatgagttgaagctggacaggtaagacgcaaccaaactggggaagaattagtggcttggtgaagtctttgaagtttatacagttgaaaacatgtagtcaatgaagaagtttaagggcagtgaaaccatgattaaagctttgtttttgaaagtgactataaatgagacttgtagggaggcaacagaaattttggaagaaaaatgtttagggctttgcctgaactaaaatagtagtagtttaaatgaatatgatgggatgtgtgctatggtagatcatttttcctgtgctatgggggtaagtgttagcttctttctcctggactagtgtgttagattcttgagaagatggattgtctaattcacttacaaatttcccagaagctgtcctagggcttccatctagtatgagccctgtaaatgttatttcagtgtatggaataagatgattttctgtccacatccattaagggcagctttagtcaaaattaatacatggatatggttgttaaaaaggatttttccacattgaaatttaaatggatccaaatcttctagtctcctggggcttcactttttacccagtaagatgatgggagtcactatccctggaaatagaaggttctagctgctctactcacacacatacacacaaaaccctcagtaatcatttttacctggtattttcgtaggagggtaaaaagatgacatttttaaagctcttttctctcatctcaaccagcttctctcatctcagcttgtctgtctgtataacttgcccctggactgtggttctgagctcagcctcaggcctattggattggccagtctccaaaatcaaattctgtagcacattgtcccatagttttactgggtaaaggaagatgaagacaatgcaggaagagaacaactgactgtcgaacattattcttctcaaaatatattggtcattcccactctaggggaaaatttaaagtactttgggttacaatgaaatatcagtagcctctttttcccctaattaattctttccctgtcctttctggattctgaaaatccactggtgttcgggtataaactccgaaattgtttgtcttgcttatgagggcattctaattctctgtctaaacccctcttatctattttctacaggattgccagttaaaatacaagactccctgttaaaatttaatttcagataaaaaataatttttaagcataaggctgcagcatgggatatactcaatacaggtacacctcaaaagtattgcaagttcagttccagaccaccataataaatcaaatactgcaattaaagaaagtcacactcttttgatttatcagcacatataaaagttatatttatactatactgtcgtttattaaatgtgcaataacgttatgtgtacaaaaaataccttaattaaaacattttatttactaaaaatactaacaatcatctgagctttcagggagtcctaatctctttgctggtggaaggtcttgcctcgatgttgatggctggtgattcatcagggtggtggttgctgaaagttggggtgattacggacttttttttattttgagacagtctcgcactgtcgcccaggctgcagtgcagtggtgtgatctcggctcactgcaagccctgtctcccgggttcacgccattctcctgcctcagtctcccgagtagctgggaccacacgcgcccgccaccacgccctgctatttttttgtatttttagtagagaaggggtttcaccgtgttagccaggatggtctcaatctcctgacctcgtgatccgcccgccttggcctcccaaagtgctgggattacaggcatggccaccgtgcccggccagactgtggaaaatttttaagacaacaatgaaggtcgctacattgactgactcctcctttcgtgaaagatttctctgtagcatgtgacgccctttcgtaccatttttacccacaatagaacttctttaaaaattggggtcaatcctctcaaacccagcagctgctttatcaactaagtttatggaatatcctaaattctttgttgtcacttcaacaatggtcacagagtcttcaccagatgaagaaaccactttctttgttcatccataaaatgcaactcctcatctgttcaagttttatcaatgggattgcagacattcagtctcatcttcaggctctacccctaactctagttttgttgcagtttccaccatatctgcagttacttttccgctgaagtcttttttttttttttttttttttgagacagagtctctctctttagcccaggctggagtgcggtggtgcaatctctgctcactgcaacctccacccaccgggttcaagtgattctcctgcctcagcctcccaagtagctgggattacaggtgcccgccaccacacccagctgatttttgtatttttagtagagaaggggatttcaccatgttggccaggctggtcttgggctcctgacctcaggtgatccgcctgccccagcctctgaaagtgctgggattacaggcatgagccactgcgcctggcctccactgaagtcttgaggccctgactatcattgataagcgttagaatcaacttgcaccacaatatgtattgttttccaccttctaagtacgtggtttgtggtaccccaaaacaaccacaataataacatcaaaaatcgctgatcacagatcaccataacaggtataattttaattttaaaagttcgaaatatttcgagaaacaccaaaaggtgacatggaaaaaggaagtgtgcatatgttgtttgcaaaatggccacagtacacgtgctcaatacttggttgccacaaaccgtcaatttgtaaaaaatgcaatatctgcaaagtgaagtgcaatgaaaagaggtatgcctgtttactaaaaaaaaaaaaaagtcattgtttatctgaaattcaatttaacatggtttcctttatttctaatagctttattgagatataattcctgtcgtacaatttagcaatttgaaatgtacaatttaatagtttttagtaaaaacaaattcatatctccatggctacagtagacatttttgctactcagaaagacccctgtaggcctttgctattacctctcaatgccccatcccctgtcatccccagacataataaaacacaaatgtactttctctataaatgtgcatattttggacatgtcatataaatagaatcatgaactgtgtacacctttgtgacttgcttctttctcttagcatgaagtttcaaggttaatttctgttatagcatgtatcagtactttattatggagcaatattgcattgtatggatctactatatattatttatcatttcatcacttgatggacatttgagttatttcacattttggctattatgaataatgctgctatgagcatttgtatacaagagtttgtgcaaacatatgcttttatttctcttgggtatatatctaggagtagaattactgtactatatggtaactttaggtttagtagtttgaggaactgccaagttgttttccaaagtggctgcaccatttactttcccaccagcagtacttgagggttccaatttctctacatcttttctaataattgtcattgtttcttttttgattatggttttgatttgtatttctctgataggtaatgatggtaagcatattttaatgtccttaccggccaattttatatcttctttgggtgaatatcgattcatatccctcactctttttttaattgggttatttgccttttttcattattgaactgcaatggttatttatatatactatgtacaagttacctctcagacctatgacttgcaaaagtttctcccattctgtgggtagcattctgcacttttatttgccaaattgtatttgcttaattctataccaaaggacactcaccttacataactcaaaagtctccataaggtattttccaaacaaagaaggacttctctcactgaaaggaattttgctttcctcctggactttttggctccaagtgtggttgacttttaaaataagtttatttattttcctgattgaatttctctgtgttctcattagtcatccgattttcagcccttttctgttgaacccttttcatcaaaaacaggtactgagaaagaagatcttgttttcccttaaagttttcccttaaagttgttactgagttaaaatgtagagcctgaattgtgaagtggatgataagtggtcttcacaattaccctggaacatctccttgtacatatctaacaaacacactcttttctcgtaagaaccaaaacaagaggcacctttgtgattatctattcaagacaccttataaaatatatctcatttgtatcatctccaatagtaacccacgagccatctaatagcaatttcagaatgaataaaacaaaaaatagcaatatggttgtgacctgctttaaagatagtagtgtacttatattacaggaaaacaattgaatgggactacttaaagggtaatttatgtaaaaatatataccattatatgagatacatagtaggtgctgaataacgttagtttcataattgttttccttattcagtatttaaatttaaacccctaaaaataattcactggggtatcaaattatatgcctacatttgtaaactggaatcattcagtaactgcaaaatattaagtatctataaaaaggcctaggcattgtattagagacttaactcataatttttcatttatttaccataattctctgttagatatatataatcacttttaggttacatatatattcactgagttccagtaacatattcaaattcatataagtggtaatataaaatctgctcttcaaatatagagcagtctttcctgaaaactcatgttctttttaatatagaacatttcatttcaaatcctatatattttacaaatgtttctttttccagagatcttctctgatcactctgagtggaagtaatttgttctataatggacctccagagtaatttcactgggaccctcctatggtacttagcattttctacatttttatatttattggtttctcagtgttttcgctgtaattttatttcttctcccatcatctctccttctatattcacagtgatagatctttcactacaatgtgtttactaatatgttagaaagagccaataagtgatatgcagcagtgatccccaacctattcttatcatgacaaacatagacaattaaggcactgaaattctacttagattaaaggtggattagcttatctcgatcaataacaaaaaggatgggcttgaaaatttctaaaaagcataacaaatctaaaaagtttgtaaggaattatcattacaaaactgatgagagagagaggtacctaaaaaagtaagtagagcatagaagatgcttttactctggatagaagatgcttttactctggaaaaaaaaatccatctagccaaattttaactttgtttttctaactgcctaaaatgtgtgagaggtcaaactccagaacacatccaaaacttgagagtttaacaggaaatcctcctaacgttgagggggtatcccaaatgaataatcctggagaagagatttttaaaaatcagctttcgtattcatttcaaacccatattgacatcaattagaagttcacaaactatgaatttatgataacttttgagcagaccagagggactcctaggaaccttaaaacaaaaagaaacagtttgtaaagttgtatctttatcttaagcccaaaattattgctgcagattttttttctagggtgaggaacatcatgcaataatgataaagcatatcaaatataatcaaacctacagaaaatgaggtaaaatgagttagaaaccagaaaaaaacagacagcaagaaatagaactagaaagaatttcatatatgggaattatcagagacagatcataaaacagccatgattactacttttatgaaataaaaggtgaattgagaacatattccaaaaacagaaacctataaaaagtggcagatcaaattaaaaacttacaaaatacaacttgtagaaatcaagaatacaataactgataaataactaaatggatgaattaaatggcagattagatgtaactaaagagacagccaggaagaaagatcagggaaattatctggaaataagattgcagagaagaaaggataaaactatgcagtaaatttagttgactgggtggacacagtctaagttagcgagctatgaaatggaagcaaagccttctgattccctgttactttctgggtgttagaataaattgctttactttatacttcaatataatttgctataatcactaaaggaatataaataggtaaattaacttcagaaattatgtcacaaaaattgcaggataaaaaatgctgcataccttaaatatacacaataaaatttattttaaaaattaatgaaaatattaataaaaatagaatagtggataaaataataagaaaaattaaaattgaaagtacaaatttgaaaggagaacacagggtggttgaaaaaatgaaatgtatttacaatgaaattaaatgcaaattgattaaatgctctagttaaaaacagattatcagattgaacatgtatattctgtttataagatatatgtgttatttagatgtacctaaagcataaagataatgaaagaataaaaatgaaaatacgtacaaatagtaatcaaaagtacaaataataatcaaaagaaaggtgtagctataaatataacaaaaattgtcttttagccacaaagcattactggtgataaagaggttcattttataatcatgaaggtttgagtcctccaatcctaaatttatattcacctggtaacagttttaagatatataaagtaaaaactgataagaaagaaacaaatattgaccaaaattaaagaaactgagaaaacaaagagtaggaatgagttagaagaattgaacaataaaataccatacataccaaacaactgaaaaacacaaattacttttaggcatatttgtatccattatggaacattcacaaaatttgatcaagtgctaggtgtggtcatgtaaatttatatcaccattttggaaatgttggataatatctattgatagtatgtttgaagttacatactcctttgaaccagcaatctcacatcaagaaaaatactcttgagaatatcatgaaattgtcttttagggcatatattcaggaatgtttcataccaagactatttataatagctacaaactggaaatacccaaaatgctaccaataggagcatggataaaaaaactgtattgtattaccaaaaaaaaaattctatacaacaaatggagaaaatacaacatctacagatgtcaacttgaatgaatcatgccatcaaatcttgagtaaatcaagaaacattccaaatgatgcttaaaatgtaattccatgtatgtaaaattaaaaaaaaaaatattagtaaatataattgtttagaactgtgtacataaatagtaaactacaattttaaaaaatgtgcattacaatggtaaagatagtggctgtttgcacacagagtgggaaggaattatagagggcttctgacatgttggctgtgttctgtttttcagcctggatgatctaaacatgtatattttccacgctgttctctttgtaagttatatttgacaaataagaagatttttaaaaagccaatttgaaactattttagggttcataggtataaaagggagaagtagctttcagccaaaagggagtctccagttttacctgactgccttaagagccttggaggagtcaatgtttatcttctctaacccttccagggaggtcattatgctatctcctactttgtagtccccagatcaaggaaatttaaaatctcactctacttgatcttaatgagctcttttgtttctttacctccctctctccgtctctcctttctgtttacaaaaatgacaggttttatggtccctgtggtagcagttttatacagtcttataacaaattgtctcaacctagatgctattgacatttggactagataatgctttggtgtgtttgtagtgagggctgggggtgggggtggggctggcttatacattgttggatgttttgcagcatctctggtctctacccctagatgtctgtggcacaccctcctttcccccagccttccttcccacttgtgacaacaataatatctcaaaatattgctaaatttcacttaggggacaaaacagcactgggctaggaacaactgacctacagctatgggcaaaaggagtctttaacaactattgttggatcagtaggtatacattcaggcttcacatataggtgcaggtttaagcttggtaagagaggacatgaggaggtatagctaaatatatagaggtacgctatattgaagggaagttacatctgctggctctaaatggtgaaaattgagtggaagttttgatcagatgaatgacaacaggaaatttttaaaaagcccaatcattaaagtgatttgcaaatacattaaggtagggatctcccatcatggttagtattctagcagaagctgcattaattcaggaatattgaagacattatccctggatatttggacaattcagagttctggtttccaaggtctcctctactgtcaggaggatgacctttaaataaaagactcctggacttatcagggacagtgtcttgtaaaaagccagtgtctttctctgctgtctcggagacagagtttgctattaaggatttttcattgcttttttgattgcttgtggccttcaaacagtgttgagtaaaaatacattttcatttttccagcatttctgagccaggcaattgctatttagtttagaaaagaagattggcttttttctattagtgagtgtaaaaaaaaagtattgccagttgcagaaaaaaatccatagaaagactctctctcatcatcatcatgtatatttgactaaatgtttcctcttttttagggggagaccacatgacctggatgacctaggatagccctggttatccttctgcctcgcatcctgtctagtttagcacttgttctaggtttttcacttgtaataaaattgtcattaataaccatgacatttaaataatctggaatgcttttggtagactgcgactttgacttttagcttccaatatagtcttacctaagagcaagatttttaacatgcgcttagaagtcgcacatctttcttttcatgattctttccaaatgcatcatagctaaatctctctttgtaaggtagcaggcagatgtttgctgacataacaaagtcttctcaaatgcgactaaggactgctaactctgtggcttcaggtgtctgtggtagaggcatcgggcttgttgcccccagcaaccacttggtgtaccagccagttctatgacctgtgctaaacctgcctggtgcaggaagatacagtacagcaactgggagaggagttagagtaatacatggggcattactggttaggaatttgtagaatatgtgagggtaataaaagttcaggcttccagttgtagaatgcctagaatagtataaatgctatcactacagtggttgtgttatttattgtatggaataaatctacaactgtttatttagtttgttgtttggcaatgcttatttttaaataaacctttttagcagcagtagctcaaataaacagaagtgcatgcttagagaatttccagtagctaagaaagtcaatgataaacatgtacttgagcaaaatgtttctctacatttagcatcctccatgggaactgtagtgaaatcactgaccacacaaaagccagaagacctaaatctgctaaagaaacaccagcatctacttaaaaaaatcacttgttattttaggaaactgtgcctaaggatgacaaattaatacagctctgaagtgtgactatcaaataatagttcttttaaattaacttcactcattttctattgcaagtattgttatccatatacaaaaaaaaagtcaaactgaagtagttgcaaatgtcttggatttattaacagatatctttgcaaacagttaaatgatgccagttttatatcgatgttatcagatggtttaaagagaaagccagttaaggccaatatgggaatttcttctagttcatggaatcaaactaaaagtttagggagttcattccaacgtaggtaatgcatctcatggtaatttcaacgctacaagaaatttagttataagagttcaaaatgaatattaaagagaaactacttgtttctttttcacagtttaatacacatacaatttttgaatgattcttgtgtcatgataaaggcaatgttcttattaaattatggaagccatggagcagaaatgtagtaacaatagcctgtgtacaaacataattcataactgggtccaaaaagccttcaataatctaccaataaaaagaaaagctatagttgtcaaaatttacaaatatgtttaataaaagaactttgaagaaaaactaatgcttattattaaatatatattttagcctggtggccctcgtttctctctacaaggcttatccttaattgtttttaaaaatgttgagcttttacataaatacttggcaaatcaatgttaagtgttccggaatcatatataactttttttgggaaactcatttctaagcattctcttaccaaactcagttgggaaattttaataaaattatgcattccaaagacatgccttcttgaaggtagagttcccagaaagataagacattaaaaattatccctgcaaaaataaaggaaagactgaatgaattaaacatgaatccaaagtttggacaacattgaattttagaattccattttggcattttagaatatcttgactcactgaaaaattattaaaaaaaagtttttcctggagctttgtttttaatcgaatgagtttatattgtatattagaatgacatcaatttgagaaggcctagagttttgcagtatcctaatttagtgaaatattttaaagaatgataaaaggcaatttatttgttgaattgcatcttgttaaaattattaacaaagaaaggtactgtaaattgaagtaaaaatgtatttatgaaaatatttggactgaaacatttgcatgtttcaatatgaaaagaaaaaagagctgagaatagagtgcacttagaaaaatagattccaaattgttgcaacaattttagtgaaagtattttctcaattaaagacattatggtctatacaataatgtaaatgaagaataaatttaaagtattaaaaatatgaaatttattatacataaaatgcgagtccatacaggtttacaggtaattaaaaataatgccatcttttcaagattccttctcccattaccaatgacataatattagagacagatttaaattaaaagttgattaacatatatgactatctatgaaagatgattagttcgatgatgttattttttacatgttcaaatgacaaaacattttttgttattttgcctttattgctattatataatgagaggagatatatattgtttatatattttagaaataattttacttttaacattgtttttgaatagaaatattttataatctaccaacataagccaatttattaattaataaacagttatttttaaaaatgtgatacattatttttgacaccccatttcattctccaaaatatcccagtttacacattaaatcacgtgttcactcatctgtgataataatgacagagtgttctgtgaatacacacatacacacagaggggcacatgtactctcaacaaataataggattttttaaaataacgtattttcaccttcacctaatcttagtcaacagattctaagtgcttcttttctttaaatttttattttgtaatgttaagaacatttaacatgatacctaccctcttagtatatttctaaatgttgactagtggtacactgttgtacagcagttctctagagcttattcttcttgcttattgattactaatttctcatttcctccttctcctagcccctggaaaccactatttcacaattcaattctataaatttgattattctttttttatgaatatataacatttgttcatatttaaggagtatatgtgatactttgatataaggatacaatgggcaaggatcaaatcactgtaattaggatatccatcgcctgaagcatttatcatttctttgtattaggaacattattctactcttttagttattttgaaatatacaataaattattgttaactaatgttgccctattatgctaccaaacactagctcttgtttcttctatctgactatatgtttgtaaccattttagacacctcatataagtgaaatcatgcagtgtttgtctttctgacttacttcacttagcataaggttcatccaagttatggcatgttgcagatttctttcttaaggttgaatagtaatccattgtactatatatatagtacaatacatatatagtactatacaatggattactatatatctattactatacaatggattactatatatatagtactctctatatatagtactatatacatctatatgtatatagtactatacatatagtactatatatgtatatgtatatagtactatatatgtatatatgtatatagtactatatatgtatatatgtatatagtactatatagagagagtactatatatatatgcatatatgtatatatctctcatttttttaatctatgaaaatttaagttatttccccctcttgactattgtgaatagtgttgcaatgcacatagaagtgctactatctcttcaagatcctgatctcagtacttttggataaaatcccagtagtagagttgccagattatggtagtcctattttttcttttttgagaaacctccaaattttttccattgatgccgcaccactttgcatttccatgaacggtatgcaagggttccaatttccaatttttctccttccttgccaacacatgttattttctggggttttgtttgctctttttttttttaataatggctaccctaacaggtataaaatgacatttcgctgtgtttttgatttgttattctctaatgattagaatgttgaacatttttacatatacctgttggctatttgtatatcttttttttttttcgagaaatgtatatcaagaccttagctcattcctgagttggcttattgtttgtttgttttctattgagatgtaggaattccttacatgtttgggggtctaacatatatggtttgcaaataattttctcccattctgtaggttgacttttcattgctgatcatttcttttgctgtactggagcttcatagtttgatgtaataccacttgtttgctttttattacctgtgcttttggtattatatctgtgaaaatactggcaaaaacaatgtcatgaagtatttcccctaagttttcttttagaagttttacagtttcagacctcaaatttatgttgataatccgttttgattttttttttgcatatggtataagataaaggtccaatttccttcttttgcatgggaattatccattttttccaacactatttgttaaaaagaatgtatttctctttcaacaaagtaggaatagaagaaaattacttcaacataatgaaggccatatatgaaaagtttacagctaccattatactcaatggtgaaaaacagaaaaagcttttcctctatgatcaggaccaaagtaaggatacgtatcatcaccatttctatacaacaaagaggagaagtcttaaaaagagcacctaggacagacaaagaaatgaaaggcatccaaacaggaagggaagatgtaaaattgtgcctgttgcagacaacatgatcttatatatggaaaaccctgaaggctccatttaaaacaataagaagaacaacaacaaaatgttagaactaataaatgaattcagcaaagttgtaagataaaaaaccatatccaaaaattagttgcatttctatagactaacaacaaactatctgaaaagaaaattaggaaaacaatcccaaatattgtaaaaccatttacaatagcacaaaaataataaaatcttaggaataaacttaactaagaaggtaaattacttgtatatttaaaactataaaaatcatgaattaaacgagacacacagaaatggaaaggtattttgttttcatggaaaacaatattgttaagacatccatactactacccaaagcaatctacaaattcaatgcaatctgcatcaaaatctcagtggtattttctaccagtaatagaaaaatccattttgttttttttttttgagacagagtatcgctgtattgcccaggctggagggcagtgatgcacaatcttggctcgctgcaacctccgcgctcccgggttgaagctattctcctgcctcagcttccgaactagctgagactacaggcacatgccactacacctggctaatttttatatttttagtagaagcagggtttcaccatattggccaggctggtctccaattcctgacctcaggtgatccacccacctcagcctcccaaagtgctgggattacaggtgtgagccactgggcccggccagaaaaaattttaaaatgcatatggaatcacacaaaataatcaaatagccaaatcaatcttgagaaaaaagaacaaagccagaggcatcacactttctgatttcaaaatattttacaaaactacagtaatcaaaagagtgtggtactgacataatgacatgtaggccaatgaaacagaacagagagcccagaaataaatccatgtatatgtagttgactgatctgggacaagaatgctaaaaatacacaatggagaaaggatagtctcttcaaatgtcttccatcattaatttattcactcaaaaatatacattgaggccaggcacagtggctcacacctgtaatcccagcactttgggaggccaagactggtggatcacctgaggtcaggagttcaagaccagcctagccaacatgctgaaaccctgtcactactaaaaatgcaccaggcatggtggtgcgcctctgtaatcccagctactctggaggcttaggtgggagaactacttgaacccaggaggtggaggctgcagtgtgctgagatcatgccactgcactccagcctggatgacagagagagagagagagagttctgagaaggtcccacacctcatggaaaacttagccatacgagatacagtccttatatcaaagcataatctagtgaggaaaattatatacacacactatatatttgcacacaaatatatatgtaatttaatcacagtgggctaactgtcatgtcggaaatctgtgctggatgtagatattacacaggtaatagaattagcccagaacactttatttacggagcatctcatggaactggagtgctaccaaacacatttttggaaatcccactctctatagaagaaaatatttaaagggtttttggtaagtgaacataaatcagaattttctattttgagatatataggagttggattggaaggttgtagaatctctgagttgtccaaataaatttagatgactgccgctagagaaaaactgcctttgtcgggaaagaaatgataaagggctggaattgttttacatttagtcacactaatagggatgcagagagcctgagaacctgcatatgagagatcacagattttgaaaagagccagagcttgggatgattgcccatataaaaatgcttaaatgtcttaaacataatttgagtggaattatttatatttcaagattaacatactgcttgatacaagttgcctgcacattttcctttaagtaatgggctaatgggctctgcgtctctttgcctaaattaaatgtagtttgcaacaattcaaaatgcaaatattttttaaagtagtctttttttttttttttttgactggcattcacaaaagctacagcactcttgtattagcaggtaaaatctggaccttatttcatcctggacaatccttaagctgagatattcgccaaatggcattatatctgctttgtaaatgttgatctcaggctccacttattttagccgctgggtgtggtttgtcccagagtctcctgtgagcttattttgctaagcaatcagttacactctaataattgatcagcctttctgtgttctttacaaagcagacctatcactcagcaagattttttaacactattttcatgaagtctggatctactgaggatttgatggattcaagaagacaaactaaatgactttttggctacctcaggatagacaggggacaagaagaaagcaaaaagcaaaaaaggaaaacaagaatcaaatcattttccattagacatgaatggctcaaactagtgctctctcccttataagaattaaatttgttttactcgcatagagttaggggtcagaatttctctattttacaaacagcatattttcccttttgcttttgcactttaagaacttatatgtgggggatggggaattgaggtgtctgatttgttagttgaaggttatggtaattttttttgtttgctcgtactcattttacaagtggttaaaactttggtgatcgacatgaagacccattttcttctcttgcttggactcagagataacagatttgtgcttaattcccagccaagaaattggatggaatgaattaccatgttgtagtaaagactttgtaatctggagaccttgtgattattaattcagaggggattcatcagggtctacctctgttggctgattaatcagaggatgacatcaaggtaactgggatattgtttgggcctcaagggttcttatagtgcaaattattaaataatttttattattaaatatttttattattaaattgattttattattaaattattagatgcactaaatgaagaatgaggatttattaacttattattaaagatattctgaccaaaaaagataagttgacatgaataagcaagcactctaaacttggagaaagtaggtttaggaaaaacttgaggacccaagactgattgacagcatgacactgaaaatcttctgagtttctggttactcactgtaaaatgcatgtaatgttcacctcatgggtttttgtgaaaatttagtgatatgcagaatctagacgtggtctgtaagctacacttgcaattaaatataaaatattattatttttatttaagttataattgccttttgaagaatttccttaggtcaattcatttacaaatggtaacatttaaattatgatatgccttgcctacattttcatggaatgaacagggtattaaaaaatgttctacatatcaaaccctccaaaacaaattagcaagtatgatcaagtattatgtagatggttaggggcttgcaggacaatggtgactttcgcacctttgtttttattgagttgtaaattgggaccccttttgtttattacatgatcatccatcttagtaactggccttgccttgcacctttaatagagtttgataagagtcagttagatttataagcaatgactttacacctaagggtgggatatgaaactcctggactattagtgagcaaaagatattttaaattacataaaagtgttatacagccttcaagtaagaaaataaacatttctaggttattcaaacattttttaacataatttttgagggggtataattttagatttacaaaactttataccttcaatttttgtttttaaaataatggtattaatatatcctatggctttggacaaatagatttaccacttgacctcagtttctggttccataaatcaaggggtttagactgagtgagtatgaaaatctcttctaattagaacttcgttgaccccattattaatagttatttaatgaactgatgttggaaaatgagaagcagcagtgttgctgcctcagatttgggcagggttctcttgatgttggcagtgttgttaatatggcaacacattccctgttcattcatataggtcaccaggaatttatgaggaaagaatgcaaattttttgaggaccaagtgagttccagagaccttcaaacaatgagactaataatagtgaacagtcattgagaggtctctgtgccccagatgtgtaccttacctcatttgatagtcacaacattctagcaaaagctcagtttatcaccctacattttcaattgaaattaaaccgggttaagtgattttcccaggcagaaagtgactgagccagaatttgaatctgtagtgtcctggattcagaatgtgaactattcacctttacaacattctgcctatttctagctgcagtttctatcctaaataaatcatttctgattgtattatatcttgattacacatttcaactagaaatttagttaaacacaaaacaaaacaaaacagcaactcagtaattaagaccagagttctgtctgcttttccttttaaaatatcttaccatgatataatcagactctaatgctacatggttattaaggaaatttttctgttatcagtttttttgtgtgtgtaggagtacttgattgttccatttattgcaatctatgttccatacctaagatggcaaaaccctaactctacaacagtagccaagcagacactctgaaaagtacgaaatgaatttgagattctacaaagaatctccacattttttttcaccagaaaaaaaaaattgttttctcacaaggttctgctaacagaaatatctgagataacagaatcagtaaactattaccttcgaggccaaaatacattctaaataagttatgttactgttgtccaaaccatgtattaataggtagaggaactatactctaggtaagtgggaagaaggatcaccaaacattgaagtttggagggcagcaggcagatggggaagaggttgtctctacagcctcagaagtgcaatttatcttcatgacatcagttagatcttcattgctcaggtcccaaaccttgacctaataccctgagagggcttcatcccgcaagattggatttactctatttacaagagaaactggtgtataattcacagcaacttaatacatttgcaattgaaactatagtgatacagccaactggacagctcattgtctccatttagagcaatagttcatacctgtaacactgcctgaaaagagcttccacagacaggaaacactcccggtaatgaagaatgtctgcatggactgcatgataagggttttgtgcaattgttaaagcatgagctctaactttacctcttctgtcttaaggattctttaacatagcaccgtggctttacccctgctacagagaattctataggaaaatcccattgtaatcaaaggattgctttgtgattattgagatgctaacagatgattttgtcatttatttgtattttatgtaatcagctaatgatatttacatacatctttctctatgtctactgtgccagggacatgaatgctaagtcaggacaaccatacctctgaggacagtccttggatgatatctgcaaaaattgcctctgtaattattatgatttttttcaatctaagatccattgttaaccagctcccatcttgactgccgtttttttttgtttttgtttttgtttttgtttttaatggagtctcgctttgtcccccaggctggagtgcagtggcgggatctcgtctcattgcaacctccacctcctgggttcaagcaattgtctgcctcagcctcccgagtagctgggattacaggtgcttgccaccacggccagctaatttttttgtattttagtagagacagggtttcaccatcttgaccaggctggtcttgagctcctgccctcgtgatccacccaccttggcctcgcaaagtgctgggattacaggcgtgagccaccgcacccagccgtttactgccgtttttttatattaatataatcaactacttttgactaagtcaggtaactggtctccctttgtagagaaactttgaaaacatcttttctcatttattttgctcttactccaattttgctctaagaagacaaacacattttccttattttgaacttggcagtaggagaagtggactgctgttgctgctttgtttttttcagcttgctattttccatagccgtgctgtaattaataatcttttgtagtcaatagtttctaactattcagttatcccagttatccatgggattcttaaaaaaaaaaaaattgtcccaatatgctttagaactgaactgcacttcctgcctgcctgtctgccttccagtgttgtgcttttccatctctctctcccttcttctgttttctcttctttctctttttttcccttcctaagttcttcccttccttctttctttgagaataattcaggccaaaagatgttttggggggtcagacaaattaggtagtgagtgtgtatgtgtgcatgtgtgagtgtgtgtaaagatgtgagtggggatgtgtttgtgtgtgtgtgtgaaagggtgtgagtgtgagtttgtgaatgttggatggcaggcagacagtatgcagcctggagtgttggagcccaggtggagtaaggggacatccacccagggaagggcggagagggaagtagtcagttgccagcaagatgagatggaaaagtgatggagggattaatccaatatataaagatatggagtataatggaagccagttttctcactattggagaaaagattgacagcatatggaaatagaaaacattagaataagagttataattttggcttgagattgaaggtatcagtgtaaatcacaattaaactgaaagatacattagatatgttgacgttctaacccccagtacctcaggatgtgactatctttagagataaggcctttaaagatgttttaaggttaagtgaggtcattaaggtgtgtcctaatccaatatgactgatgtccttgtaagaggaaatttgaacacgcaaagagagatggcgggtacacatgtgcagaagaaaggacttctgcaagccaaggagtgaatttccaggaaaatcaaccctgctgtcaccttgatctcagacttccagccttcagatccatgagcaaataaatttctattctttaagctactcagtcactggtattttcttaggatagccctagcaaactaatacttattggtagatataaatatgaaaataaaaatgaatgtcaatatgagtagaaataaatttagatataaatacgcatgcatatacgtatatgtatatctgtatgtaaatatatatactcatcttgtagcaggacgatccacagacaagaacccctcggacaccgagttgtggaaggaaaggcctttattcagctgggagcatcggcgggctcacgtctccaaaaactgagctccccgagtgagcaattcctgtcccttttaagggctcacaactctaagggggtccatgtgagagggtcgtgatcgattgagcaagcagggggtacgtgactgggggctgcatgcactggtaatcagaacagaacagaacaggacagggattttcacagtgcttttccatacaatgtctggaatctatagataacataaccagttaggtcaggggtccatctttaactaccagacccagggagtggctccgggctgtctgcctgtggatttcatttatgccttttagtttttacttcttctttctttggaggcagaaattgggcataagacaatatgaggggtggtctccgcccttaatctatattgcctcgctctgtccactaaagagggtctgggaactgcagtccaccgataccagtaagaaaaatttgtgttctaaatacctggttcttggttgctaaatgctgttccacactaaaaggaaccagactttttaaaaacattttactttaagttctgggatgcatgtgctgagcatgcaggtttgttatataggtatacatgtgccatggtggtgtgctgcacctatcaacccgtcatctagcttttaagccccgcatgcattaggtatttgtcctaatgctctccctcccctttccctctacccactgacaggccccagtgtgtggtgttcccctctctgtgtccatgtgttctcatttttcaactcccacttatgaatgagaacatgtggtgtttggtgttctgttcctgtattagtttgctgaggatgatggtttccagcttcatccatgtccctgcaaaggaaccagactttttagagaaatagctgattactagacctgggcagggaaaattcaagatgtagttggaacattttattttgtcaaaaagaaaagaaatgatcaaagaattatagggacatatagaggagagtcaatttatcaggcatcccactagaaaaccttgagattttcacccagtaagtgaaacaagataaatcttgaatataaactgatagaaattaataaatgaacaaatcaaatggtaaggaatcacatatttacatcatttcaaggtaatatcctgtaaaatatttatcaatcacaaataataaagaagtgactaactgtactgtaagaaatcttggcagatatgactttagtcaagtgctcaaagtgaacatcataagtaatggaacaaactaaatcttggaacagctgatagaataaaacaaggaaaacagagcatcactcttgtggcagtcttgccaaaggcataaaagctgaatataatcctgtgaacacattagacaaacccaaattgaggaaatactataatataatcgggcaatcttcgtaagtgtcaggaaagattgggaaatttccaggttgaaggagactagtattgacatgacaggtaaatataattgtgatgcatgatcttcatttagatcttttttttttttttgagaacgagttttgctcttgtctcccagactggagcacaatggcaagatcttggcacactgcaacctccacctcccgggttcaagcagttctcctgcctcaacctcccgagcagctgggattacagggacatgccaccatacccagctaatttttgtatttttagtagagacagggtttcaccatgttggccaggctggtcttgaactcctgacctcaggtggtccacccgactcagcctcccaaaatactgggattacaggcgggagccaccgtgcccagcctagatcattttttactataaagctgattattgggataactggcaaaacttagatgtggtctgtgggttacataatagtaatatattcatattaatgccctaattttgtcatcattttgtagaaataatgcaataaaacattcagggctgatggggcatcatgtcaacacacctcaaatgattcaggaaaaaaatataaattttgtactatttttgtaaattcaagatgaaaaaataagtattgctgttacaagtaatttatctgtccatctgtccatgtatctatccaccaatgtctttatccatctcctattaaagaaaactaaaatcagaaactttttttgaactcatattaattcttatattgaatttacaagtttatggagtctgttacctgagagttagaaaagataaaactcaggttccactgttcgtccagggactgtgatgagtattttcatctatattaccttatttacatttataatagttccaagaggtaagtttttgtatatgcattttacagagtaagaggatgaggctctgagaatttgaatggattattcaaggattcattcgttcagctcctgcacatcagggctcagaattcagtgccttctgccgcctggagttctttctgataaatcatggtaacttcatctggcttagggggataagcttcagtcaggcagtaagattctctggagcctttttgcagtgctagggatatgacaactaagcaaagacttctgagaaattgtcaagggagtccataaatttcagtggaagtagacctaggttagccatttaataatgagagtttttgccttggttttgtcagttattttttcttgtgactatttaagagactcagagacccagttgctttatccctaaaatgggcacaacttcctggcctgtaatttcattaggtggtttaaagaatacatgagatgatgagttaaaagtgatttgcacttctaaaggtgctatattgacctagcatgatgctgatttgtatttgggtatgagttgtccttataattagggtagaggttagaacaaaggaatacattctccctcatagatgagtcaatccataatctccaggaacttgtttttttgttgttgttttttgtttttgtttttgttttttcccctaaaagtttcaggctgtggtaatgcagtagagtgattgcataattgattccaatctttcattgtcctcaatccatttcccctgccctacaactatgtaacatcctcccaatcagactctgaactcaaccacatgacttgatttagccaatgggatattaacatatgtgacacaatcagaggcttgaagtcttgctgattgggtttgttctcacttgtcctcttctttaccctgaaaggaaatgctcagataagcaggtggtttcagcaggagggtgagagacatggaggagggctagtttgctctacacatccattgccttcctagatgagttgacagagagctgatctgtacacatacttagcgcacctaggagctgacaaaaccatctaatttactacccacagatagctcagttcaataaacacttattattgatagctcctaaacaatacattgtgattttagtaaggcatgcatatatactatgataaagtaaaaagcaaagtttctgtaactttaacatgaaaccaggagcttcaatattactttcgtacctaccagcttccattttcagcattaccttcagatgcccctatatctgcagcaatcgaggactgtatttcagaaataattaatttaggaaataaaacagcaactacttaagagatgctgatattgaacttccacctgaaatctatcccattgcacatatatctagggctcagtatagaaagaaagaactaagtatgactgtgacctagaatactccttggaaatggaaatagttaaatcatctaggagcttttcctctggaattatgggagctggtttcccttttctttttggatgggtgggaggaaaagtttgatttgaaatataaacctcttttagtgtaattattttataatgtcttatttgaaacaatatatacacagtcatatttcttaaattattattataattcaaataagtaaggatattgtaaatctcccttccaaatttttaaagtaatcttgctaatagcatttttttttttttttttttgagacggagtctctctctgtcgcccaggctggagtgcagtggcgcgatctcggctcactgaaagctcagcctcccgggttcacgccattctccggcctcagcctcccaagtagctggtactataggcacccgccaccacgcctggctaatttctttttgtatttttagtagagatggggtttcaccgtgttagccaagatggtctcgatctcctgacctcgtgatccgcccgcctcggcctcccaaagtgctgggattacaggcgtgagccaccgtgcccagccgccaataacactttttaaactcctgtgcatcatctgtgtaatgctatctttcttgcagcataacagacgtatttttattgatcgtaatatataatatcaactcttttttttttttttttttttttgagatggagtctggcactgtcgcccaggctggagtgcagtggcacaatctaggctcactgcaagctcctcctcccgggttcacgccattctcctgcctcagcctccagagtagctgggacgacaggcgccggccaccatgcccggctaatttcagtagagaccgggtgttagccaggatagtctcgatctcctgacctcgtgatccgaccacctcagcctcccaaagtgctgggattacaggcgtgagccactgcggctggcttataatgtcaacttttaaacttcattcctctgtaatggattttgcatggccaccttgcaggtagaatcagaaatgttgcagtcctcttttgaaagtgcataacaaaatcttgttttaagagaacaggtgctagggcttgtattctaaccaaactccagttcttagcaactgcattctaactgcagaattactcatacaatttgaactacactagatttctttgttcatctcttcttaattaataattgcaatgttagggaaatgcaaaagttgcataataaataccgagatagtttttttttaaatgatatatgtagtaaacatagtttaacttaaaaacaacatggagctggcatcgtcattaacaagctgtgtgattttgtacgtgttactttacttctccaaccattgccttctttatatgtgttaatatggaaaaatgtctatgatatatgttcagtaaaaaaagctgaaacaattgtatttatgctctaatcctgtgataatatagatgggattttaattatgcaagttcctaaagttagaaatacgtgtataaaagtgagtttttataacaaaagtattcctagggtactaaatacttataaaattagtctccacccaatcatccatcttcacttaacttttccactcatatatcatgcatgtgtaaatcatctctaactgatttctaaatgttacattccacaaaacaacataaatgcagggcaaatcaaacacacaatggaattgcatatcatgtactacatgcaatatttcatggatctctcatagtaagattgaagaattactcaaatcccacccaaaactgttgcccatcaattactgtatttgaaaaatagggggaaaaaacaaagaagaaagggaggaaggtagagaaggagggaagaagacaacatgatgatgatagagttggcaccgcaaaatattttctaaaaatataccaaaagattaagcaatctatgcaatcataaaatttgtagagaaaaattactcaaaagtgtcagcacatgagccatattttattcattcgtaaaattattatatggaacaattaaacctaagttttattaaatgtaaaacgatatactatctacatattgagttttatatttctaattttgttctttttaaaataaaataatgctacataatttaattttatccactttaaatggtctaacttcattcattttcagatacagaagatcttctaggtcttctgtatagaaatatatacacaccatctgcacacatacacacatatgtacaaatacatctatctatatatgtatgtatatatgtatatatattccagtatatacatacatatgtgtgtatatatattccatgtatagtgtgtatatatgtatgtatatatgtatatatattccagtatatacatatgtgtatatatatattccatatatagtgtgtatatgtatagacacacatatacatgcatatatgtatatacactgatgtatatatacattgatgtatatatgtatgtatatatgtacatatacatatatgtgtgtgtgtgtatatatatatatttatgcacacacatatatattccagttttcaaatggagccaaaacactggatttgctggctttttcccattcaagtctagaatagactccagttctccctcagctccaacatggatgtttttgaacagtcagggaagttatagatccatggtcagtatttcacagggcacttgggatatctagctatgtttaagtatgtacaattagtaacaagaggagataaagcagaagaaactaatggggttgcactttgagtgaacttttaataattcagattgaaagatagacttattttcaaattggcctgtgatatgaatagtgtggtacaggaaagaagatcagaggataacctagaacctggaggacaaaaaaagaagtgactcatgccacgtttttttttttttttttttaaatcatggaaggaattctaggagataataataaaaccacacccagtaagatatataactggttatgaaattcttccaaattatatattcaaggttatatatttttgtctagtaaaattgaccaagcaacaagtgcccattttgctttgtgagagaaaattgcatcaatttttggataccttaaaagacctcattaaaagagactattgaaagattattataaatttctagccacaacaagggaactttccttgactaattaaggcaataatctcgtgccagaagggcctggacaagggttatttctttccgggttgtcttctggttcaatggcataatagattacaacaattgactgatctatctcattgatacttattgtctgaataatcatggccttgttacctatagcttcaacaatagcaataataagacaaacaaaatacacaaatacattctgtctctcacacacacacacacacacacacacacacacacacacgcacacgcacaatccagccttggaaatttaagaacttgtccagtcgggcaaggcaggacctggaaaaacagaaccaaatagatgtgttcaggaggaagtccagtgaaacaggcaagtggataagaggcaaagacatagacagcgtacagttcaggcaggtaataagcatgaagaaggagacagcagtaaaacataaataaattaattaattaattaaaacaaaaagcatcctggaacccaaaagcacaggcagaaagcagaaaagaggtatctaagaagcaatggtctggaatccaggcagaaggcgtgtggtcagcaccagagagcacaatcagcggacaatcatgctttgggccatttaaaagaaatacatttaaattttacacatgcagctcttggatggcattgggtgagtgcaagacaaagccctcacactgggcaacctgtcaacaacatggaacagtggaactggaactgactttggagtccaacagtgctgagctcataccttcactccagcatttacaagttgtagatgagtacaacttgtacagttaacctcctcatctgtaaactgactaataacatctctttgctcatttgaagattagacaaagtaatatacatgtgtaaaacacaaaggatagtgctcagcatataacaagtgtttatagtttatgaattttctttagagctagggaaaaaaatgagtttaagagcaggttaaccacaagaaatttatgactgaattcaatgtgcatcataaaatacattaaattcttgttgcccatacttacagagttgaagttagagctgattctagcagacaatgggtgagacacgaaatggtttcaagtaatcctgggtctgcacagggaggtgggaaatgcagagggtagggagccagacaggagagttggttttatgcagaaaatgccagcagattgattttctaaagtaagagatttttaattcaattccctttgcacctcttcctctgcctgagattctgctatattacactctaaaatagctattatcactatctgttacaaagctgatgcagaataattgagcatgtccctggagaaattacacaaacaaattccttaattctgcagaattatgcagggcccggaggggattcctcatgctcccctaccttctcatcaatgttggataattagttttctgtctgaggcatatttataacatcagtggagttatcagtggtcaataaggtgatgcttgggtgccaataattgggaaacttgacattttccaattagatgaatttctcagtgttgattgaaagatccaataccggtcaccattttctgcattattttctgggtagctcagtgggacacactgagagagtatggattagaagagacaggggccagagaagggggttggtaaaaataaggattgtgttgctggaggcagcaaaacatattttccctcatctaaagaaatttcccaagagatgaaccagaatgcaaatgatctgtgctgaagtcctcgagtagactgtgagtttcctctagttcaatgtgtaatatgaactcctagcataatgcttgccacatagaaagctctaaaaatattccgtttatctttggtgaaaggctggagggaaaatggtatattcaacattaataaatatttaacatttaaaaaatttttccttttgtaatttaccccattgtctacctccagtgaagactaattgctagaatacttcagcctgccaatgagaaaacatgttcagcaagggaagtcgggatagtaatgtcctgtattacccttgctggagggttctgtaactatccattttgtcttacttctgcccggccatttcactccactgactggttctatcatatttccatttcccaataggactcttctttccattaaatccagtggctttgctagggaatgaaaagacttgggttatgacatagggttgtcatgggcttacattgcagctgcacctctctaacttaattgggtgactccaagattcctttgtgtttttaggatcttttctttaatgatatctaattccttgggttgtcctatgtaattcatgtgtaataaacatggaattgtgcaagaccccaagttgaaagcatcagttaggagttagaccatgtaaaacctatggaaataatgaagtgtttcctccattagctagaaattgaaggagtatatcttgaagatgtgttgcagggctaacattctaggatgctaacattctatatcagaaaatccagtacctacgcccaacttcttcactcatatgctgcagaaatacagaagaaatgtacctccatacctgggacttattagcattcgggtacttggtttcaatcctaatctgagacatactaccagatccccacaccctcccctcccccaaaaattaaagcttgcatttccaaactattgacaataccaaagtctgttctcattaacgattcattaaatatccaatgacataatatttgccttagacaacacaaagtagagtataccattatgggttgcttaaatcacaaattgagctgacttcaagcaatgactcccatgagattaaaatacagtatttgaggaagtagcatgcagagataaatggaatgcttactaaagagagagagaaagagtttacaataccacttttggtatagaaacaagaatctaagggaataaatctgctttttcaagtactatttttaacatttgttacatacactttgtatttaaaaaaaatctcctgacatttatggttaagaagtagcttgcaaaatctttctccagttctctcatagaggaggaaaaaagtctgtaaatattttcagaagacaagtatgcctgtaatactatgaaatgagattaagttaccctactagtaatatgatctttgcattggaagcaaattcctttttgtgatttttttcctgagttggttatacagcagactagatgacgatgataaaggtatcaaggtctaagtttttatttttattttaaaatactgtttttttttttaaatcagatacatgaggccacacaaaacaactacctagcttaatgaactgtttcaagtcaaatagctttgcaaccaccatagcggtcaatgagtaactttgccagccagcccagaatccctgtcccaagtgcttcgtctcaaacccacctacctctctgccctacaacctagcctgacttttatagtacttgctgccttaatacttttatatttttataattcaaatatgcatccatagacactagagtttatccaactattttttttctatttggttatgtcttttgtgtcttttttagtctacatgttcatccaccattctcttcttttttttaatttaaaaacacaattcattgttgagggactgggcccattcgaactgtagtttcccacagcctggaattcgagattgcagtctctctgaatccagccaggccttcatgactttagcaggactgtaggtggagttgcttttcttcaacaggtgcaaaatgcataaatccactaaataattgagggttgaaaatggtgatattcaaaatccatatttttttttacatattagttgaaataattctgtaggaatcacttgctctcatctcctatttagttacccaatgatattgttcatataggaaaggcaggataaaagccagatatttaccagttttcaagataatgatttttttcctatcatctttgaaaggtgatcattttttttaacatggcagtatgaacacatggatttaaacttacttatttgatgcattttaatacattgcaattgttaaccttgtggaagctaaaattgtctcttatttgaagatgatattttctatttaaaaaatgctgactaatgtgtattgactgataacttttttgagtactttatatgtattattcagcgtaatgctcccagaagtcctcaaagtatcctttcacaaattagaaagctgaaacacaaaacatttcagtaattctccaaagttctcttagctagatgagataaaactgcaatagaagtcagggctaccttcttgatcctgctgcatttattatggtacaagcttactaatcaaattttttaattttcagatttagtttttgtctcctatagcaaaaagatgtatgtgagttatcaaatctacatttatgcccattttaccaaggaaatggagacttagagaagttaagtgatgggttcaaaaacatatagtatatgtgcctcataagagacaaagaccaaactctagccttgggcctcctgtcctttgaagcagtattgtccttcccatggagtgatcactgaagtgattggagatagttgacaatgtacctccacatgatgtcacaggcccagtcccggtggcaaatctgcttatctgtttccaagtagagaaaagtgatcacacacaaacacacacacacacacacacacacacccctttatgggaagagaagaatgcacagttttacaacaaatagcagtgcttcatgaatgttgcaattctaaagatcaagtcaggaacctttctaaaatgaaggcaaatggaattgtatgcaggttattgtccacagcggtcataatatctcaatgtctgatattctcttgaagtttatatttttaattattgtactttctacacagcttcagcattttttttttctaaagacaaacgaataggtaggaggataactagtgagaaccgcaccccccacacaatcaccacttcatgttttctaagatgggtatatttgcaaaaacatgtatggatctaaattctcttttatatcatatccatctttctttggagtctacagtgcatccatgatcattgtgtacccctgagttactaatttcttttataaatagaagggtttgctgaagagaatttttcagtgctgatttctgaagttgcttgttatttaggtatttttgattaggtctcaagaaaaatatatggagtctttaagatgtttggaatagaagtgccttcatagctgaatgcgaaagaatccatggacacttatttgttatatatgctgggagctggtgctcggaatacctcagagaataactcacggaagtctgaatgagtagggtgggggaatactgaaaataaagtttcttgttagatacttgaactaataaaagtttctcccacaattactcagttctaacactggattaaggcacatccccctcacctcatgatatttaagtacatgtatacttgccataaatactctgtttatctgcaagatgtaattagatctctaaaaaagtgacagttcacaagacagttatgatatttcaatttagtgcaaacctgtagatttaattgcctcaaataacaacacagattgtatttcaaactcttcaggattcaggatcatctgttatatgttagtacattattacacggcatactgtaagactgggtttacaacaaacagatgcaccaaaatgctatgcttcccaaaatgtggactttagtttttacaggaaggtgaattaaaattaagatgcagatgagcttcttgatttcacagtatgttttaagtggaattgccttgggaatgaaaactagccccagcacagtagggtgactatcacggacagtattgtattttatatttcaaaatacgtaggaaagatgattttgactgttctcaaagaaattatcaacgtttgaggtaatggataagctaattaatgtgatatgatcattacacagcatatacctgtatcaaaacatcacactgtaccccgtgaatacatccaacgattatgtgtcaattaaaaataaagtaaaactttacaaaatcaaatgagctactctgaagcatttgcaatgacttcatagtttaaactgggatagaatctcaaactagaaaagggcaaggagcctgttctcactaaccatgtcactcttggagcagatggcctttcctgaaggctgcgacattttttgcatatccctttatttcaaaggctgttatggtcatgaaatggaataatgtgaggacccctaagggagctcaggcatgttcagaaatacttgatgagattatcttccaatatgaatgtgcaaggaagtgttttaattctagtcataatttaacaagatgaaatcaagctaaagatgtaatatattaattggatcttgtgtaaccactaaaagcagtgctagagacctctacatattgatgttaagacatgaacgacatgtgaatttctatgtgaaaagagcagttatgaggacggtttgtatgatagttgggttcttcctttacacacaccgtcctcatgctgtctgctgttatactttgtgtttgcctccctgcagtggcccagcctctgaaatgttttgccttcctccactccctcactgtgttctagtcccctaaaaactcaaatgactttactctgaatatctgggatctgacaaaccaattgccatatggccagtccatatttagaggagatattgtgagatctctaatctgttgctaccactattactcatgagaacaaagatccctcctactatttcttagttttttctatagattaaccttattctctggtctacaattataatcatagttttgcaaatacagattactcattctattttagttccagggtggcaaattctcaatgctatttaaacccattgtccagtttctctatatccacatccaaaagagcagaacattgctggagaaaacctcttaaacagaagatgggctttactttgtattaaaaaatgagtcaactctgtctaataatcttaccacaattgtgtaaaaaactcatttttatactgtaaagaaaaatgaattcatagagcttctttttttcctaaaagctactgaccatcctaagtacttcttgagacaagggaagactttgtatttcatgaggtaatggaagatctaaatggaaacttcctcatcctcccaacaactaacctcaaaatccatttcctcaatgtctgtcttctcattttgcccttctgttaaaattaactcagtgatctgccttctaccaatggccagtgcgttcatagtttgattcctttcatgcatacttgctcaatgatttggccatttatcccttctttctgttgaaacatacatatccctttcttaaatggtcattgataacattttataaacgtagtttagaatttctcatttttgaaaaagaaagaaaaatcttatttccttctcatttatttcctgctaccaccctatttcttctacctgttgtttttcctataccaatatttctctaagaagtcatttatatattctgtcactaacctcctctcttcattcttcaaccattgcaacttggatttctctcagaccactgtatgaagctgctcttgtcaaggtcaccaaattcagttgccccgtatttgtcttcatcttctcacctcacagcttcatttgacacatttgatgatgttctcctatttaaaacactttctggtttttggttacatctcacttttcaggattcttcctgtctctcaggctgtatttcacaatctaacttgaagcctatttttttttctattctcaatcttaaaattttcaaattccacagggctccttcactttcctttctactgccctctcctatgttatctcattccttcccagggagttaagttacaatcttagacatggtgaagatgtttctggcagtgtgctctagagctagttaaattctgggtaagcctggtgaatctaacagtaaagttgaggcatgaatctagttgctactggtaaggacttcatctctctcagagactgctgtaagcatgggtatagtgtgagaagtgggcatgtgagctgcattggctggcggcagccctcttggtaaatgccgaccaatggcatctgcccttcttctctctgtggcctgctttgccctttctgtgttgtctggtttgtctggtgagaatgtacctttgctgctataattttcattaggcaaatatttctctttatttaaacttttaggttcaggggtacatgtgatggtgtgttacataggtaatctcctgtcatagggttctgttgtagagattattccatcacccaggtattaagaccagtaccccatagctgacttttctgctcctctccctcctccaagcctccaccctgaagtagatcccagtgtctgttttttccttgcctgtgttcctaagttctcatcatctagctcctacttttaagtgagaacatgcagtatttggtttctgttcctgcattagtttactaaggataatggcctccaactccatccatgttcccacaaaacacatgatctctttctttttatggctgcatagtattccatgttgtacatgtaccacattttctttatccagtctgtcattgatgggcgttgaggttgattccatgtctttgctattgtgagtaatgctgcaatgaacttacacatgcatgtgactttatggtagaataatttctattcctctgggtatatacccataatgggattactagttcgaatggtagttctgcttttagctctttgaggaattgccatactgctttccacaatggttgaactaatttacactagcatcaacagtgtataagtgttcccttttcttcacaacctcgtaagcatttattttttgactttttaataatagccattctgactggtgtgagatggtatctcactgtgattttgatttgcatatctgtaatgatcagtgatattgagcttttttttcatatgcttattggctgcatgtatgtctttttttgagaagtgtcttttcatatcctctgctcactttttaatgtttttttcttgcaaatttgttgaagttccttataaatgctggatattagacttttgtcagatacataattttcacatgttttctcccattctctaggttgtctgtttacactgttgatagtttcttttgctgtgcagaagctcttaagttagttcccatttgttgatttagcattttttttcttgatcatgagcctgacactggtatgggtgctgggactgagacaataataacagttaaccctgacatagaatttactttgtgccagacatgtttctaagtcctgtaatacgtgaatttatttaatcctcacaaataccacattttacagatgaggacacgtagactcagtgaggtgaagtaagtttcccaaggtcaaaaggctgggaagtggcagagctggctttgcacccagaaggtttggctccaaatccttgaagtcaccagctggtgagaagagacacaacactcgctacattacaaggtggtaaaagatgaaagagaggtttggaacacgtggagctctagggaggaaggtcctttctccacctgggaatgatttccagaggcaatagccatttgggctaggatttgacatttctaacaaaggagtagaaacaatctcacaagagagaaatgcattgcaaattgcagaaacaaggaagggtgtggccatcttgaggcacttcgagactttcatggtggctagaggataagcttgtgttgcttttgctgtgaggaaggagatggctcagaatgatgcaaagtcaccagcttggccattagcaggctcagctcaagtgcctattgcctgaattaccattcttccttatctctacaaggcagttacacaagaaaaaccccttgggtgtctctcagctaagatttttttgtagttatagaaaacctcctaaaccctaagccatgactcagctttcctgcagattaatctagatgatctaagcctagttctgtcactgcacataactcaggccccacctcctattgcataccatttaaaagcagggtgagcagcaatcaagacctgctggaactgagggggttcctcgattgcattacattaagtactgaaatatggtaattgcagacaaatcaggaagaatgggataaactatctgaagtctacctgatgtgccagaaataagatgcatgacaactcataatgcaaagacgtcaaattcgcatttctctaaagtatagaataactgttaaataaatatagagatgctcattttagttttacattcttttaacctctactattctagttattttctcttatcaggtttgtgttgtctaacaggtctgcttccgagcttaacctcatattcttgggcatttctctccctatcggatatatagtcttccatgtttttgttattttctacaaaggaaagtgctctattttttgattatttaaatattacatgttccttctaaaaatattaaatatataaaaaacataacaaaaaattcaaaatcacatgaaattatattactctgagataaccaccattaataatttgttgaacatacttgcatttgtttgtgcatatgcatatttttgtatgcatgcataaaatttcataaaatcgtattattactccttcctaacttattttcccctctcatctatgtatttttttttctctttcttcctaataccatccagctgatcatggtaaccactgttgatttcttggagcatagacttcagttgagttcaggtcctcaagatgcagattccaagacaggattatatgtgaataaagatgtatttagggaattacctacacaagataaagggaaggaaggagaagttgagaggagcctttaaacaggcctgacttccatgaaggaaaagagaaagtctgagactaccgtctagttctgaaaaagtttggctaagccgagggggattcattgaaccaaactcacccagttgagtacttacaacttgaaggaatgggcctctattatgagccatgctgtgtccagtcatcaggtgctagtagcctgtatgaagagtggtcttagtatgaacaagggttggacccagaaggacagcagctggtacgtttcctgcaacccagaaggacagcttgtatgtttcctacagcagatctgagcagcatgtagcttccttcatatttgtatggcaaagtgcaaatgcacatgcatgcataatggtccttagtcattgtttttacaaatataaaatcattttatgtacactaaatattgctcttgtcactaaacagtatcaatggaaagtcatccaagtgcagcaaatataggactcattcttttcaagggacaccatactttccaatacttatatatccaaatttactcaagccatttgttattaatgagaattctcttgaggcctaaatataaagtattaaaacacttgtaaataaaaaatttacaagttttgttttgcttaaaattaggaatttaatatatatatatagtaagtcagttgtaacacttccattttccttgagcttccaaaattttgttgacatcaatttttttcattgtcatcatctttcctattaagtttatcttcaagtattcatgtttttaaagatatatatacttaatctttttaattctcatttttgctttgaggaataattaaaaataaaaatgtgttaatatatcatatttcatgatttattgttacatattaacttttaacttattttttccagtttttaaaaagttggtattttatttgcaattttatattaagaactgatttgattttcaggtgactgacatttttattattttttattgtatccaagaataagatatgtcattacttaagttcaggctatgttttatttctttcaataagatttaataattatttcctcatatgttttataactttcttattaaattaattcttatgtatatgatagtattatcacttctgagaacagaatgttttccatttttacttatattttggataagtatcatatatccaactaccttaagtgttcctttattaatttgattgcttctttaattggccatcttgttttatctagatttattatgatattttcagtaaaattatagttttatttttctttcaatctttatctgaatttattaaaaatgttaatcatattttatgtaactatagtattaatagacacttccatcttatccatatcataatagaaatggctttagtattttggtttttaaaagttgtaagtttttgtgaaatgtctcatattaaagagtatttcctctttttctattttaatttcattttaaataagaaacgactggtttatttaattaagtaatgttttatgtattgaaataattatatgactctttttctgttagtttttcaatgatgcatgagtcttataggtccctaatatattaactaaatcattattgtgttctacctggtagtatttattgaagattactgtatctttgcagacatagatctatttctaatataccaatattcctgttctataattttctttcttttactctctttactgggattgatttttcatttcatgcctgcattaaaaatgaattgataaagtgtccatctcttcctatagtctgtaaaattttaattatctttgtaattgtctgctatttaaaaagaaagctagacttaggaaaaggaagtatgttgttttaatgcctcttgggggaggaagggataaaatctttaatcatttacttgcaccttccaccgtaaatggcctatttaaatttgctgctttttgttgttgttgttgttaactttgctgctttaaaatttacagtatgccatcatttttacctggcctttaaaatgtattgaaatatttggccaggcaccatggctcacgcctgtaatcccagctctctgggaggctgaggtggacggatcccctgagctcaagaatttgagatcagcctgagtaacatggcgaaacctcgcctctaccaaaaatacaacaaattagccgggcattgtggtagacacctgtggtcccagctacttgggaggctgaagtgggagaatcgcttgagcctgtgaggcagaggttgcagtgggccaagatggcaccactgtgctccatcctgggttttgtatttcttcccaacactcccatccttaaaatggatcctaacccttgaatttcaagaaatatgctagatcccaatcacatttctcagttttgcttaaaccagatttgtctattccaattctccaccatattctctgtctcatgcagacttgcatgtgtaaaataaccttaactgtaatatctagagaaattgagaggaaaagacatagaggtgaggagatgtcagctcctgaaagatttttaaccatcataagccatttgaacttcaatatgagggcaataggggtagggcatagaactatattaagcaccaaagttacttaatgagactggtttattttaaattctctacttcttttctcttaaagtggtcgttaataacatgcatcttggaattagacaaaccttcctacatttatttgatttatgactttaagcctgaggttccatatcaataaaaattgagacactaattttgttttcacaagggacatctgaaatattacggtgctaaattatgtgcacagtgcttattacatagtaaacaatcaataaatgatattcaatcaacaatcaccatcatcttcgtcttcatcatagtttctatctctattatgttacagatataggtaaatgtggtctttttagtgaagcatatagatttttcccacagtcttgattggaaaagtgagagtatagctgattgagagaactcactgtcagctgccaaccaatacagactgttcaacttttgtttttattttgttgaaaggtctttctcttgctttcatagcttgctgtaaatactgcattctaatcactatgatataaatatttttgataaaagaattaatggaaaagtaattgtagagacaaaaaactgagaaagtttggcattaattatcttgaaacacagtcagtccctctgtcatttgcagatagtcactacttttaaaagcaaatagttctattggtcatggcaactctcagtagcagctatgagaaataaccaactcatggctgaatatagtaaaagttttttctcaatcacatcacagtttaatgtttgttgggtggctctcctgagcagcaccattcctctggagtgacgtggggacctactgcttctatctagtggtcggccttgttggaattttctatttctagctgtaagggcaagggacacagagtgggtggggaggggacacagagtgggtggggagggcaccctggctctttactccctgaatcctaacatggcacactgcacttccagtcacgttttagtggccagatattagtcacaaggtcaagtataaatgtatatttcagccttctgatatttgcacacagacttcctgagtgtgcagaaagagaaaaatgggcagtttaggaaacccagggatgtggggaggtgagtgtatacccacgtatataataagccagcaacagctaaagatttagaacatggcatccagatccatagtcattttttaaatggacaaataccatagtcattttttaaaactttgatgagattatgaatgagaaacaattgaacattattttttgaagccattatttatttatgacatttcctattcattttacatttttttcacatacgtaaaagagaaaaattggatgtacatatgcgtgcttaacagtggaatagtgttgacatattttcccctcagggtttcaccgggagttcttaactaaaaaatatgtatcctcataattaattaagaatgttattaattttgcatcaataatcattatctaggtgattttatttcatttaatcatgcaatatggctatttctacctctgagagtcagcctgttccctgagattttttctaattttttatacccagaaaacttagtatttatgtatattttcagaaaaagtattaggtgaatatttatatttttattattttattttctttaaatacaatatgtcacatacttatatatgtgatatgtttcacatatatcaaaacatcacatatttatggtgaacaatatgatgttttgatttgtgtgctataaacaaatccagctaattaatatatccatcatctcacctacttatcattttttgtgatgagaacatttaaaatctactcttttagcaattttgaaatatacagtacatcattattaactatagataccaagctaattatgaaactaaaattttctatctttttgatgtttcaacaatttcaatattttgaaaatatttaataactgaagtgttattcatttgagtatcttaagatgatatattcaaagagagatcatacaatatgataatgctattaagcatttttacaaatgttcaatgatattaaacaaattaaaattaaaagtacttctatttgtgatgagctcttaatacataaggggtcattttttgagaaacagctgttatattactttcttttctcaggtatgtagttaacagataaaagtttagataatgaataaaatctcacagatcacttttccatgtgcatacattgtttggataaacaactgattaatgatgtctcatcctttcaatcagaaatgtatttgtaggaaataaaaagtgtgaatgcttgagctgaggctgtcagtgatattattttgcataattatattttctgttgattcattttgcatatttctttggatggagcttctctgaattgattaaaacttccattttatcacctatttgaatttaatttttgctcaggaaattctgcttcgaatggacattttgatgcatcatattcataagaaaaggaaaagaaagcatagaaggtgaggggcctgggagtttccacttaccttgatccctgtaccatttatttgctggttaccagttcctcctctctgatatgtggttgggataaagttaatgggtaacctttcaggctcaacatttctcagcgtaacacttctctttgaaccatagagaaagagaaattcttagactctaacactctatcttgttgctcttaagattccaggtgaatccggacacaaagtgcctattttacacaataggatcctgttgtgctgagtgtgtcagagcataggctggcatctcatagctcttactgttaaaagaaaaaaaaatatggcaattatttctttgtcgtgagatgacattctctgagtgctcagtatcttcttaactcagcaggaatactctttgtaatatagaaagcatacaagacaaaaggcaccttcccaatttgtgtgttctttcttttaatcttgacaaaagtattgcaggcctctttggtgccagattctgtataataccctgaaatgcagagaccttgtgtgcttagatgactaatacaattagatgacagggcaaaaagaacactgttgggaacgaggttcaggaagagtttgtcataaggatacgaagtggaagggcattccccgccagagaaagcagcagcaggaggagcagacctaagatggaataatatgaacatatggcaaactataaatttcatggaagacttgaatgtgaagtgttggggaaaatgccaggtaggcaggacatatagccacaccctactacagagaatcattgtttctccttccttacacatttggtcttctaggcagtttatctcatgtacatggagagtgaatatgggttctgacttggccttgtacagccagttaatgacttccctggattccaacaccaaaagattcagtctctgaaactagttaatagataattggaaaaatgctgcaagcagttttctcaggatattcatactcaggatccaggttgtagctcctgttttgtgggtaacagccttgactttcatccttcaatccccaccaaacacacacagacagattttgatagataagccagtctccagtggcccactttatgcaatctagacacctaacagtctccttgtttccatctgaagctgatttttgttttttgatcggcactaccactctcaggcttggttgattggagaatttgtgatgcacacctgtcctcaattccagaatgctgggaaagtcattgacatgactttcttcagatgatttggtttgggccgtattaaattttgactatttcaccaccttctaatctagtacttagattcattccagcgttggaaggtatgtaattctgttgtgatattaaggtcactacagaatcagggcaaagaggagaaacacagaaaaatgaaaacaaaacacgcaggcttctaatgagaagtcgcatgatacagactttaaaagcatgggtttgtgagcaagacctggcttgaaattcctcttgttctacctcttattcgccatagagatgattgagcagttgacataactagtgacttagtttcgtcttccataaaatgtttttctacattattagcttactgtgatgaaaaaataggataatgcatgcaaagctccttttcccagtacgtggcacttaataagccctccgtgaatgttaactattattcttactttcatgatggtttgtaatcccaagaaaagataacaaccgtttttccttttggcttctttctttggttgttttattttgtttgtttgcttgttaagtgttcaatagatatttgctattttttaatataacagttgactgttcttacttttttgggaggtggatgtatgcaatgtattaaatatggtaaattttcagaatcgaagaaaaatgcttcgttataatacatcatggaatagcacacgtgtgatatcttaggtgttggaccacctgagaagtaaaggattatcctctacattttgaaaagttctgtgggtgaaaagaagaaggcatggccaaagaatccgaaattaatggattagttatctctcaaaaatggaatttagtttataaagttataattaataaaataattaataaattacccattgggacagaaagggaaaacatatgaaagacatatgtttatatcccaaaatgctctgacgaacttagatttgaaaagaaaagaccatgtcaggaatagtcacatgagggttacagatttttgtctttattatgatgtggtattttgtttggacctgagaattggtagtgatagattaacttaccaagtagtagatatttaatcaataaaaaatttttctaaataaaaaaatagtcgtctgaaacataatgggctttgttagtgggaggttgtttaggtcaatacaagataatcactggtgatgttgttttgctctgctgtgggaacaaataaattccaaagttgtagtgtcctcacagtaaaggagtttatttcttattcatgtagagttgctgtaggtctggtgactcttcacagcaatactcttccaagcgatacctgaaggatccacgctgttttcacctctgtctccaccatctaaacccacaggttccatggtcatctttgaagggcagagagagacaaaggagccccatcagttcttaattcttcatattggaaatgaagatttttatggtcatatttctgtttcctaataatatttatacttagctcccattctgtctatgaggaagtcttggaagtactattttcctgtgatataggaaacacctaacactctcggccactaaggatatttctcatgactggactataggacaatcctaaatctactgtcagaaattccgatgattaataatcagggtttgcaaaatttatcaaatgaatctttaactaaacaatgcctggaaaagagtgtttaaactggagaaatacacactacccacagttaaaatttagtgtctgcctgggtataaagaatgtattatatctggtaaacatccatccctagatacataagagcactaagaggcttctcttgtaaatctcctctgtgtgtataggtagttacacttgacatttgctttgcttgttcaaagctgtctctaatagctcagctaaggagataatatgtgagacaaatacatataaatcaatctcatatgcaagatatttctgtctctataaatgatcctgtactccttcttgccatctctaggagcttaattccttactccttcattgaattgtcctaaatcctgctggtactgcttccaaatgtctcttcagaggtagtttctttacaccattacaaatgatttttttctttaatgaaggccctcatatttcatcttcaaactaattaatgaactcatatatattccacttttttgtagcacctcttcttttgcagctgcagctgccaaaatcatacacctaaagctgaagacagtaaggaccattgtagttaagcctggacatcctggagtgagacaccctgtaaccttggacttttcttagcctttctccttagttttgtcatttcttaaatgagagataagagtatcttatgggcctaaaagaggaagataatgaaaatattatacattaaaacatcatggcacaaatgaactagaacggatgcaggccatagttggacaaatgccatacccttcattgctggatcatggaagcttctaggagtattcttgataaggaataaagaggcaaagtcatgaaggaggacacacttgcctaggttttggcagtggtcatttatcagcattacaggagcagtttagtaatttaatattagtgtgagctacctatcagctgaacatcagctttagtttagttaactctgtgaaaacactgaacacagtgtacagtcaaggctaggttaggaaatgctgaagtaacaaataaatccagatcttcaggtattaacaaaaattagtttattctagaatgatggatttagcttgggaacagagcctggagatttgtccatagctctaaagcacttctccctgaaggtggccccctttacttctgcacatattccattgaccaaagcaagtttcatggtcatcccatcattaaaagagtagagaagtactcagaagaggtgagttaggcatatcgaagagccagggtaatgtctaaatatatgatgtctagctcattgttaagtgctccagttattattaaagtgtattctgattttttcatttctcagttcaaattacgtttattggatctgctttacctccttataacacggaaactccttgttgtcgttgacactcattgtgatgtaaatcctaactacattcctgtttatatgttatactgcttcacttcattttacctttggtctgtccaagcagaattatttggttttctcatcaatgcattgtttttctctacatcactgcctctgatgtccctttaccattagtgctttaactgaatctctccatgccagtaagccttctaacatgtcaggttctcaagttcaaatgccctaaatttccattcctgatatcaacttctgtagtaatatattccgttaactcttattttgctgttagacccaacattatattatagtcatttttatatatgatgatgtagcattatagcctgaaaacttatgaagagtccatgcctgattcatcatgtagccccacttgtgagtaccttactcatagcagttcaataataatactaataataaaattcatcataatgttacatttagtggtggcatcagcctaatgtaaaatgagcattggattagatattttaaaacttctggattttatttgcaccccagttactaactagcagtattacctagaacaagctgcttaacctattggaatttcagttttctcaactctgaaatggatgagaaggaactttaactgattttccccttctgtcttacaatattgttgggagaaccaggtcagatatgagatcatagtatgtgaaagtattttacataaattgtcctcattctgatgtaccaaagctaaactctggttttaagtctacagtggattgattcttcagtagcatttaattctgtttcccattctgttttctccacggaatgcttcttagaaaacgttttgggtttcataacattttatctttctggttttctgcctatgtctcctttagctgaccagtacagctaacctttctctttatcccttctactctacactctttgctagataagttcattcataccataacataaattcccatctatgtacaaataactcacaaatatttatatcctgtcaaagatctctcatatgagtgataaatccaggttcttggttggtttctctacttggatatactaacatgtctcaagcatatcattgccaaaaccacactcttgattcacacttgccttcataagtcttgcaattttccagtgtttatttttttctgcaaatggcacaaccactttcttagttttaagtgttaaaatctaggttttctctttcttcatccacaatgccaaaagtactgacatgctgcaaaccttaccatgtgttcttattccattaatgagaatctaagccaaatccccaccctttcttataccttccaaggaaatactttcttaactggtatttctttccttcatcaatctattccctatactgaatcttttcaaaatgtaaatcctatgctattacttaaaatagttaccactgtttgggaataaaggttaaattccttaacctggccttaaagaccacatgcaatgtgttggcatctacttctgtagcctcatctcctgtcaaacataatgttctctctacaattttgtcttgcgaatactttccatagttgttatttttactatttgattgattagtcaattaaatatatatttttctcattggagactttgagtttcctgatggtagggagaggtgatcttttttatatctcacataacaagcactgtgctttgcagacctcaagtacttaataaatatttgttaaatgaataaagagtttagtaggtagacctgttttttaactgtgtattgagattgactttttaagaggtgcaataaaggcacaaaaaccataaatattaatgggcatgatttgaccttcaaggaaatcaagatctattggtaaatatgcttaaaaacagttaagattgaggggaaattttgcactaaggaagcagcaaatcttctcccggaacgtggtttgatatatagggcttgacagaagaagcttccgcttctgatctctgattttctggaggactcatatgtaaaatttctcaaacctttcagtattttctgttcaaagattataactgtctttcattgttatgtttccttcaatgtgacaggtctcagtgaccacacattcctcatatatatctcaaacctggaaaatttcagagtactcaacacattttcaactataaattccccttttctgtgcttttagatatctatttatctctagtttatgtgttgtatttttgttgtagcttgattatttctcctcgactcaatttattataaatgtttccatacataggtatatatattttagaaaatctattaatattttctctatgtcttctaggttttgtatcctgttaatgaaagcctgctctaaactcccttatttaattgttaaacatttgacatgaaaaaatcatccccttaacttataaataacttatattaatcaataagaaatatacaaataggccaatagaaactagacaagggattgaacaaaaaaggcagtagaaataataaataattttagagaaaaaatgttttccctcgcatttaaagacatacaaaacaaagcgatatgagttttgtaatctgttcaagttgataacaaatgtttcatctaggttatggagcagtatttattattatacatcactatttggagtgaaaagtagtacaaaaatttggtgaatacatcaacaatgtctgtcaaaatataaaagtacatatctttccttatcagccatactactgttgtgaatttactcaacagattattttcaaaagaatagcgagatacttctgcaggaatttctgttgtacaaccctttgaactatcaaacaaaaaatgttggaaacaagctacctatgcattaataggaatgtgattagataagtcatattgattcatccaaagaaaagtatgaagcagatcaaacagtttaaacaattgaagtggcatctgtgtgttcaagtggtaaccattaagaaacaaatatacaaaaagcccatggtgaataactagtgattactttgtataaataaaaatgtatatacaaatgtatgcaaaaatatacatgaaacaatttttcttgaaagatacattaaaaaaatgtatagacaatgaatacctttggggaggagtgcagttaggaagtaagggaggtaataactcttacttctcatttttttcatttcataactatccttgtactgttttaagtatttattacacagtatgtgtattactgtcatgttttttacaaaaataactgacattaaaccattttaatttctatgcttcacaaaaaatttctaaagctaaggattttaaaaattcttcctccttttgtggaagtgaattctatacttgaacatatttaatattgtataatgtatcctcttttctttgaactgtagccctcagcatttttttcagctcctcgtgtgttcttacttactgaatctatccttattaagctgctaattctgctatcaggaagttcttggtaagttcttggtatttaggattgtgcaacaaaaattgaagtcaactattttgtacaaaaaaaaaatcattattctacattaacagttgattttggaggtacttagtaaagtcgactcaatcatagacctccaaatggaacaaacacccttacttgcatttcattgtgatttttgcaggccctttgcagtaatagttctgaaaaacagtcagaaataaacaacttaaaccctcaaacatattttatatgctttgaatttaaagcactcatttaaaagaaaaattcaatcaggtggttttttttgtgtgtgtgtgtgcctacatttgtttaggtttcttcttttattttttatttttggcccttattcctctttcttttctactttcccagaaattctggtaaaagtaatgtaaaaaatgtgaatacctgatcagaggagttgcttaagaaatgtctcagctgaaaccagtactttagtaagagtgctagctgcttaacaagtcaagggtgtgaggagctatgaataaagagagaacattttgccatgaattattcagttaaccatgggatgctgttatctccacttcagtggcttttaattgcacatgtaagaattctgcttatctggcattcaatttgatgccaaggtgcagcttgctcaagcagggctggaggcaggaaatgaggatctcatcagacaagcagctgccattcacgaatgcattaaagaatatggcatagactagcagggaaggcagaagacagacacagataatggcaatggaaggatatgtgagaatatgtgacaagagattgtcttttccttttgatcttattgcacattgctgagtcttgagtgaaaagtcaaattgtgtgtgctacctaaatgtactgcattgcctttgttagagacccaaggttgacctctggagcaaagatgacaagttgctctttaaaccattctcttggaaaatctggtattctttcagtctaaatggagtcctgactcaattttgagattctgttggttttaatttttcaaagtttacttcagataagtttgtttatcaagataaataactttctcaaagcctttttcttatatcaaatttgcagaagagatatcttttggcacctgtgctgtaaatgtttcaaaacaatttacttataaaataccattttaaatattttcagaagatttcatttggaaccccttctccatttaaacctctccgcatagtatgtgattcctttatattattgcatacatccatttccaaattgaagtgcttatgcaacacatgagtttcatcagttaccatttgctgtgtgctgtgtagtgcataggagatgtagagattagaagtatccacagataaagcacccttaccttatggagttcaaaggctaaaatgaagatgtgcaacacaaatctgctggtctgcatggctgttgctgcatgggaagtttatgccagacaaaatggaagcacttttgagggtttgattacccaaggcttcctgggagaagggactggagaaactggaagagacctcaaaaaaggcttccttcagaagacaacatttatgaaatatgataggtttgtagacatttctaaatttggcgaaagaagaagtgcaggaatttcaattagtatagccattatggaaaacactatggaggttcctcaaatgttaaaaaatggaactacaatatgatccaaccaatccactgctaagcatatatccaaatgaaatgaaatcaaaataccaaaaagatacctgcactcccatgtttatggcagcactattcacaacagccaagatatgaactcaacctaagtgtccatcaatggatgaatggataaggaaaatgtggtcttattacacaataaaatactattcagccgtttaaaaaaaatgaaccatatcatttgcagcaacgtgggtgaaactggaggtcatataatgtcaagtgaaataagccaggcatacaaagacaaataccacatgctctctcttatatgtgggagctaaacaagtgaatctcatggaggtagagtagaatgatggttaccaaaggctgggaagcatagggcagaaggaataaagagacttgtttaatgggtacaaacatacagttagatggaaagaataagttctagtgtttggtagcacagtaaagtgactgcagttaacaatatagtgtatttttcaaaatagctagaagaaaagatttgaaatttgttcccaacacaaagaaattataaatgtttgaggtgacggatatcccaaatacacagattggatcataatgcattgtatacatgtatcaaaatatcacaagtacctcataaatgtttataattatgtatcaattaaaaaagaaaatgtggtatacatacataatgcaatactattcagccttacaaaagaagggatttgtgtcattttgataccatagataaacctaaagtttatgttaattgaagcatgttttacttaaacattatgtaaatgaaataagccaggcacagaaggatgaatatcgcacaatgtcatttacatgtgaaatttaaaaagtcaaattcttagaagcaaagagtagaatggtggttaccaggggctgagaggtgaggggattgtggagatgttggtcaatggacacaaaatttcagttagagagaaagaatgagttcaaaagatctattgtgcaacagggtgcctatagctaataattatgtattgtattctcaaaaattgcagagtggatagtgttatcaaaagaaataaaagctaagtatgagaggtaatacatatgttaattagctccacttagcattccacaatgcatacgtattttacaatatgttgtacacaagaaatatatacatttttcatctgttaaaaatagaaaacaaaaacaaatctgtaaggagaaaaagtttagtatcagaaattaaagaatactgaatttaatcataaaaatggcctctgaaagaaagttgataatcctgggggacagcataagaaaaaaagaagaaaaaaagaaagaataaaagatttagagctgtggtgacaagcttggagggttggaagaatagcaggttattaaattactttttgggacaatagggtgcacaaggcagaatggcaaacaatgtgtgaagagtgcacatggtgaggtgccaatttgtgaaatgaagtccatgtggatgttattctgaaggcagtgaagaaccagtgaataattttaagcaggagtgacgtgatcagatttgtgatgcagaacaattgttctgatgacatcgttcctttggcacagttgttgatggggctccactataaaaacgaacacaaaacaaacaaacaaacaaagaccacttcatattagcatttcctatggggccaaaaatcaaagggacaatatagattaattgaaacagcagatcatttgatatcagaagaattgggtcttgttttatgttcttccattttttagcaacataatttcggacaaagtatttctcctttcccattaggtttaagttcaacgtatgtcaagagcttaaaacaatttctcatgcatgagtgaagcttcataagtgtttggggaataaatgaatggatttctgggtctccgtattcttctactaagtaaggaggatcaaaaaaatgttctgagagtcatcttccactactttggaagtgactacaaagtgacacatgagattagaagttaagtgaacaacctatattgtatcccttcagggaaattatttttgtattaatattgttagtctggggaaagtatagtgggagaggagaaactatgaatcaattttcagacatctttttctcctctgttttgttttgtttttttaattttggcagtctcttctttcctgccttctcttttgctggatgtttttatattcctacattttaaatatcttacttccaaggatgcaatcctgggacaccttatctttttgcttactgggcatttctgtacatacttttcccccatgtacttcttttcccttatattccactgtgctttccttccttaaggtctcaaaaaaaaataattcctgctcccctcccctcctagacatctaatataatctttccaatgggcctgagcttttccaaaaggcaagcagaaccatttaattaggttgtgtttagtttctgcccagtgaaagtccctgaggaaaggaacacaaaagcaggctgtcacattgaaatatgtgagggttcatagttggggaaatatagaaaaaggaaatgcttataacttaatttattggattcagcatagttacttctttgatattgttttgaagaacttgatgtgctagacaactgccttttgtgttcaatctaccatctgaagtcctcacttctttactgtaattgctgaaaattctaacccccaggaaaggggacaaatttcctgaggattttatcttgtaaactcttgcagcaccagtccctagcccagtgtttgagacataataggtttgttagtaaataaacaaatgtctctaggcacatgctgatggcttatttttgcagaaggctgaagctgctgctcaggaatttgctcatcatcagcttccttctagtgacacctatatcttcaattgattctggactcttcatctcaaagcaatgagtgacttttatttgccagttctatgctttggttaatagttttccaacgttttattattttgttcctctaatttctactttttttggttgcagttattcaagagattgtgactaaatgctgcattcttagaaatttcttctctgaatcaacctctagtttgaaatgcaatatataattcccaacataccaagatcatgtgtcttattcctttagataaagtttactatcttaccttgtttcaaaattgtgagcatgacttttataataactctgcattttattacaggagggcaggtaccatgctgtgatcttcctatcctggggcctagcacagggcctaacagaagtcgtcaatatgtgtttcaattgaattaaattgaatgaagtgtaatttctactcaaaacttttatagttataggaataagaacaaattttacaaaaatcattgtaagttacaaattaacctaaaattacacagtcatatatatctagcaggagaatttagacaaattctatacaattaaaagtaaagttgaatatatcattgatatttaggtattatttttctgagaagagaagcttgatcatatcagaaggatccctacatttaagagaaaataatcccattgttttgttgcactagcttaaaaaaatctttctatgaccttgaactcggtaaacactgaaaaatgcaaagtgtttcctctcaagggcctcttttatggatgtttcatgaattttcgggatgatgctgttcatctatgttaatggattagaaggaccattgttctaaacagtgaaagataaatatacagtccctcataacagttttgacctaaacttttgtcatatttataggttttcttcctctcaacaatttattttctctcatggctttgttaaattaggtagttttattacaaaatttctttgcaagctttttaaaaagtctcaggaaactgatcacgacaaactctagtgaaagtctttatttccatggtaaccataatatgctctaagtatcttctcatgaagaggtagaaccaatgttaccagcaaaacacagacaaaggccaataaagaaggaacacacaaacacatgttcattacagcaatggtgatcagggctgcagtcaccctcctttcaatatttaattcattaacgcaagcagattttttaatagtataaaaacaaatggagaaaagtacaaaatatgcagtgacaatttttgatttagaataaaaaatgttaaatgccatttattgttaagttcttaattttgtaagaaaatattttctgacatctaggctaaaatatcaatgaaactcaagtttctctgatcattgatattttagcctagatgtcagaaaatattttctgttaaaaccccgatagtaaacaggtaagataagactctgaaagctatatggtttctgtgcggactacttggcaataagtaaacaaataagtattgctgtgttacaataaaactttattttaaaaaacaggtaatgtgccagaattgccccttgatctatagtttgccaatctcgtttattataaggtaaaggtagtattattcatattctacagatgagcaaatggaggttctgagaatttaaacagctcaaggtgaggcagaatcagaacacaaaccaagtctattgcattttaaagcctgactcctaaatagctacgcttatttaataagaatagctggcatacactggtgcctaatgggacaacagtgtgctaaattgtttatgtccattactttgcttaacttagaaaatccctgtgagataggtatgattagcattctctttttatatatgaagaacagatacttgggaaatctaagaagattttcgaaggtcaataaaatagtaactctatctttgttcaaattaacttattctacttaattcagtgactgaaataatgaaatcattttttaaatgtgacctctatgatctcaagaatataaaaaggaccatgcacatttaaagagtacctgagttctggtggatgctttgagatttgcaatgcttatttctcaatctgcagctttactttgattgtaacttggtttccattcagtctactttatgaggtgtaatttcatgaagaggcaaaaagggtaattgtagtgtgcagttaattagaatttctaattaaaatcatccttaaaaaaaacagccaatgccaatggaagaatgattactaatctgtaaattaaggaaactgtatactgcaagattttttttttctactggattgaaaaacacccagtttaagttaacatatcataaataaagataatcaccttaaataaaggtaaaatgcatagggcaataggttgatttaatttggccaaatgtaattcagttaaatactggggattctgtaactaacaactaatcttgcttcacttcccctccacagccttcaattccttctttctaatgtttgggcacagatttgattttctcaaataagggctcagtaaacctgtcaggctttcacaattccattcgtatgtctatacacaagcacacatgtgcgtttgcgtgtggttggcaagaacacatgtatgtgttaatgcatgcctgtgagtgtgtgtgtctgtgtgctctgtgacatatgggtaaaatttgtagcatcttgcttgatactcacaggttaacttcttgcttcaactccatgttgtagcaacaaacatttccccataatctcatttcaccaggtgtaggaaacttcaaactatcttaataacttaagaatctttctgaagtcatgcagaatctgttcattctgcatttgtggccatggttacataaaaaagtaatcattgggaaaaaatcttatttatctgtatagtaatagtcaaaattttgggtcaagctgtctctgaaaattatgctaagagctttgatagaatatcaatacagtcactccttggtatctgcagtatctgtgagggattggttccaagatccccaaggataccaaaatctaaggatgctcaagtcacttttataaaatggcataatatttattataacctatgcacctcatcccatttatatatctctagattacttataatacctactacaatataaatgctagctgaatagttgttatacttcattatttattggtattattattttctatgtgtgcttgtttgaatccacttatataaaatctgtagatatgaaagcctactgcatcatgtttactttttagcatgctaaatatgtaaatatctttttgaaaattaataaactgtatattttcgagcagttttagatttacagaaaagttgagcccaaatacagagttcctatataatcactccccccccacagtttccactattattaacactttttacaattgaagaacaaatatggaaatattattattaactgaagtccgtagtttccattagtgctcactctttgtgttctttgggttttgacaaacacatgatgtcatgtatccaccatcagagtataacacagaatactcacatttccttgaaaatcttctgtctttcatctattcatccctccatcctcccctggttcctggcaactactgatattttttactgtctctatagttttgccctttctaaaatgtcatatagttgggatcaaacaatacgcagtctttttgggcttatttttatcacttaatgatatgcatttaggattctctacctttttttcatggcttcataggttattcctttttagctctgagtattatccaattgtatggatgtaccatagattgtttattcttgtttatttattatttgcagttcttctattgaaggatatcttggttacttccaagtgctggcagttatgaataaagctgttagaaacatttgtatgtaagtttgtaagtttgtgtgtgtgtgtgtgtgtgtgtgtgtgtgtgtgtgtacataacttttcaactcatttgagtcagcacctaggagcttgattgctgacagtaagagtatatttagttttataagtaactcccaaactgtctctcaaagtggttgtaccatttacattcccaccacaatgaatgagagttcctgttgcactatatgcttgccagcctttgttgtctatgttttggattttgatcatctaataagtgtatagtggtatctcattttgcaattcactaatgacatgtgatgttgggtatattttcataggcttatttgccatctgtatatctcctttggagaggtatttgtttagatcatttcccactttttaattaggttgtttctttacttattgttcagtttaaaaaattccttatatatttttcatacaagttctttctcagacagatacgtgttttgcaaatattttctcccagtgtgtggtttgtcacttagttttcttaatggtattcttcacagagcagaagttttaaattttaattgatttaaacttaattgataagtcccacaccaatttttttctttcatagatggtacttcatataaaattaattgcccaaaattatagagatagaaagtagaatgatagttactagaatatgtgtggggatgaggagaatgggaaattattgttctatgggtatagagtttcagttttataaaatgaaaagaattgtggagataaatgttggtgatggttgctcaatgttattattgtatttaatgcaatagtacaacattttaaagtgtacacttaaaaatgtttaagatggcaaattttgtgttatgtgtattttaccaccaaaaaatttggaaaaaacttcttcccaaacccaaggtaacctagattttttttccttgttatcttatagaagttttatacagttttatattttacacttagatctatgatctattttgacccaatttttgtgaacaatgtaaggtccgtgtttagatacactttttttgcatagagatgttcagttgttcagacacatatattaactttttgtttgcttctttattgatatttatagtatcgaatcaatatttccaaaataagaagctcatcaaatgcctgtgttttagggttcttctttgccatttccttattgctaggaattcagcatctaggcactcatttgaatggatttgtttgaatatttatactcgtcagcaaaaaaattcccttttcagtcttagttgctttggctgctacgaacagggtggattcttttgagtatatgagagtatttgaggtcatggatagaagagcttcattattcaaattccatatcatcagaaaaatggggaaataaaatgggaggtaaggatacatatctcttattaagtagctttgggagatgtcagaatataccacatgtaaacttctgttttcacaaagggcagggggatgagtgagcacagggacctgccacagtttctcctatgtagcttctgatcatttctgttaaatggtatggctcccttcttgcactattctttaagtcttctcagttagatcattcttggacatctgttcagcttaaaaatcagatgttctggggaaaatacttggccaggtttgtaacaatttcatcagagatagtgctgtttttaaaggtaattacaacatatatctgcatctggacaaggaccaaaaaagaatgcagaagagggaaaaatatctatatgtgttgtgtgtgtgtgtgtgtgtgtgtgtgtgtgtgtgtgttttatacacatatacacatgaacacacataaatgtttagtttcctcttctttcctaacttgaaactatttatgacaaaatagtttacatttatatagcatcatggtcaaagtgctttacatttaataatttatttaatccaaagtggaaagaagctcccttttttaaattaacatcaaagcagtttattttcagggtgggaattcaaatatttgagcatactttttacttggcaagtcattttctcccctaggacagataagaggctattaaatctagcacagcagactgagaattcagcaaatcaaatgacagataaggaattgaaatatgagctgcatatcaaattctgaatttaggcagtttggagaaagaaatgtttcaatggttttaatgggaatttgtgttttaaaagggtgtgttcaagaaatactgggaagaggattaaaaaatagtgacaaaaataggtgaggaagaaaagcacatgattgaacattagaagtaaatgcctaaaatatctgtacttctcagttttacaaaacaatcaatagtaaggtgatatgagaacattctcctttagctcttgctctattaaaaaaataatactgattcagtaacagtctaaatcccaagtgaattttctccactaatgccataaataactcacttcctgcaggcacatcatttttcactgttgaaaattaaaattgttaagtagagtattggcaagagagaaaataagccaagctttcataccttgttcttgttgcttctatatttacgtgtgactgaatttggttggatcttaagtatttggtactgtgtttgtcataactacttgtaaacctatgtcttctagtttagctttaaacattacgcttgtgatttctataaaaaccttcatgttttacaagaaatgaaatgtgttattttatattattttgcctgtgacatggaactcccaagtatggttatttttggtccataagcatgctactcatacagttccacaggaccccatgctaaaaagggccttccactcggttgagtgctctgccatcactattaatttttgaacaagggcctctacattttcattttgtactgagcctttcaaatcacatagctggtctggtatgtttgaataagaagttcagtaacaaatagaccaaagtctcaatctcacccctgggccttgcagccaaatgaacatggaaaagctaattggcactagtgagcctattctacccttatttataacccttatttataaaataaggattaaaactgtctctctcaaaaggctataatgggaattgaaaaaataaaacatttaaagagcctcacaaataaggcaaatacgtttttgttgttgttgatgtttcatttgaatttatttattttttgagatggtgtcttgctctgttgcccaggctggagcgcagtggtgtgatctcagctcactgcaacctctgcctcctgggttcaagcgattctctcacctcagcctctggagtagctgggattacaggagtgtgctgccacaccccaccaattttgtatttttagtagagacagggtttcatcttgttggccatgctggtcttgaatttgtgacctcaggtgatccacctacctcagcctcccaaagtgctgggattacaggcatgagccactgcacctggcctgttttgtttttaatctcaggagccaactccattaaatttgggtggcttcctggtaaacttcagccagaaaagctaacgctaaattcttatctaggcaatagatattaatgtgtataaattaagccacaaattattgggttcatgagtaaaaccttactttgaaaaactctagcttgaactttgcaatcctcactttcctttgggaatgaatatttttatttttccacattctctcctgttattagggcatcaatgttagttcataattgttgcctttttttctgcttaagtgatctcctatcttaataatcaaaacataatttgttactttggagaagggcactcaggtgaaaaatgagaatgcagatataagcatgatgctttgacagaacgccagccattgtcttttagcattggtttcttatgaacaatatttctgtgctatgactggcctcatttgaaggtatgttctgtatgggaggtgaaggacacagtgcttttggctgcagaaatctggagagttggcacagggttttaaatgagggatcaagatttactggaggatctcttccccaagcaattgttgttgctgttgttgttgttgttgtttgtcattgtcttttttggggggggaacggggggagttttggctgtatgggtgagtataattaataaaaatgcgtcgaagactgcaaataaatgagtttatgagagggaagaatgtgcaggtaattgtgtaggctagcccagagatatacccagctctgctctcaactcataaggttttttttttaatcttaattacttttccaaataagcctttctaattgaaaaagtattcttcaacaagaataattaaaactatggaacatgaaagatgggtaattagttagctcattcatatcaattgacagatgaataaactgaggtcatacaatttttagtggactaatgaaaataagcagaaagtataacctatctgaactctaagtctgtgtgagtttaggttcatgaacgagtttccccagaacttaatcaactgtgcactaaataacatagacttttagttctggagggcagaaccagccttgagagttttgttaactacagatttttactgtacactgtcctagtcacagaccacccacccctcttctccggctacacagtagttacctcctcctcatgtgggcctgccagatccactgcagattcttaaatagccattgctgtaccaaatgaaattctatctgagaacctgttttgagggtattatttcttctctacaaccttgtggccatctcacctacactctctaagcctcaattattcatctgtaaatttagcataatgataattatctctgctcagcctccttcaaagcactgaattaatggaaagcttagaaaacatacactgaagcactttttagtgtgctctatcaattgaatattatagtgttcatattggctttttataataggtatactactattattgatattaacacaataatgtgttcaaactattgaaataggattacttaaaaactgcgttaatattcaatagcttaaatctgaattgtaattacttttagaactttatacactaagtgatttctaaagtgactaaaatagggaagaatatttcttgttttgaaggagcataatgatttgcaaatcatggatgataggttcaaagaaaaataattggttgaaaaacaaactgttgggtaccatgctcactatctgggtgacaggatcattcatactgcaaacctcagcatcatgcaatatgcccatgtaacaaacttgaacttgtacccctaaatctaaaataaaagttgaaattattaaaaaaaaaaaaaacaagaaaacgaaacaaagctaaactgagaaatatttaggaatatgtttattatccttgggagaagacaaggagaagctgttggctgtttgatgctctaacaaaattttcatcaaaaccgtattcccaaaatggccttgaaaggcaactacattgactgtcaatgataacagcaggattggacagcatggttgttggttacttacagtctggaaccagaatgcctgagtttaattgctggttatgccacttatcatgaaatattaagcaaaatacttggcttctctgtggtttaatttcctcagttataaaatgaggataatctaattgggttgttataatgagtaaatgtgaaaatattgcttagaacagtacttggtgttttaagtatttattaaatatatttcttaactggtgatcaattagattctattcaccatctttattttatcttgtgtttagttgcttttgaaattagaaaaataaatcaagtagcatgtcatcatatctatacaatacatattttttaaaatgtggacatcattcaaatgctcaggcttgtagaatttatgtatattgttaacaattttaatgattttgaatgtaatcaaaaagatattttgaagaggaaatggattggataattgtgatctgttgattttttcatgctaaaaaatcatgttttttcatgtttttcatgttttcatgttttttaaatgatactgaaatctttgcattaggacaatgtttctcaaaatgtgacccaggaacccctcaggtgtccatgcctatttcagagggttcacaaggtcaaaactattaacaaaataatactaagatgtgatttgccttattcatgctcattgtctcacaagtatatcatatttttccaagattacatgacctatagtattacaaaagttgaatgcagacacagatctgagaactcaactgtcttccattaaaatagtcattaaggatattcattaaattgtaaaacaacaccactctcgttaattttattttgtttttgaaaatgtatttttataaaagtatatgctattcatataaacatgatgtgttagtactatacattttaatgaagtaatacataaatatttttaattttcaaaattttaattctttagattaattattaatagatataactggcttaaacaaaagctccttggcatccccagtaagttttaagaatgtaaaggggtcctggaaaaaaaattaaaattactgcattagactatctgtagtctcttagaaattcatcttgggcaagtggtttaatggagttgcacaagtctgtggaacaaccaagaggtaggcccaacatcatccaggctctccagcccaatcttctctggatgaatggaacaactagcttctgtgtgttgtttctttcagttctagagccgctgatatgacagatggacaggccatgaatcagagagcacaggggttctctgtttagagtcagtaaaaacatgaatttgagtgacatttttcaaccagagctcctgatatttggaagctggcagcaatacatatttaaaacagtatgtaggcacagagagaaagtaatgtgaaagtgtaaatagtcgatgtgatgatactcagagatttaaaaattatatttccattttgaggaaagtagtttttttgtgttgttttacaagattgaattgctacataattttacaagtcatatacatgtgtttatatacatttgatagttcactataattgcaaaaattaatttagcttcccttggaattgagagctgctgggttcaaaatttggcagacaagtacaagtgagcacaggcctacccaggacctcctggttccaaagtgagcacaggcctacccaggacctcctggttccatccttttcccagctgatatggtttggatatttgacccctctaagtctcatgttgaaatgtaatccccagagttggaggtagggcctggtgggaggtttttggatcatagggagcaccatcctcttgatgatgagtgagtttttgctttagtagttcatgtgaaatctggttgtttaaatgagggtggcaccttacgcctcctgcctccttctcttgcccctgctcttaccatatgacatgcttgctccccctttgccttcctccatgattagaagcttcctgaggctctcaccagaagcagatgctggagccatggttgtacagcctgcagaactgtgaaccaattgaaccttttttttttcttttttgagatggagtctcgctctgtcgcccaggctggagtgcagtgggacaatctcggcttactgcaagctccgcctcccgggttcaagcaattctcctgcctcagcctcccgagtagctgggaccacaggtgcccaacaccacgcccagctaatttttgtgtttttagtagagatggggtttcactgtgttagccaggatggtcttgatctcccgacctcatgatctgcccacctcggcctcccaaagtgttgggattacaggcgtgagccaccgcacccagcctaaaccccttttctttataaattacccatcctcaggtatttctttatagcaacaaaaaatggcctaatacatcaaatttctaatattagcaaggaaccattcccgcagagttggcccagtttcccagagccattccctcattcaggctgtctcatatttggttatattagcctcagatgttgaccagtaattaagcttatatttggttctactctttacaacatggggattgctggcctacgcattgcaagggagactcacctcctctctgcgttaccccagtgctttcttagcacccagactctctgtcagtctcccttaactctgttctctcccagatcctgcttggaaaattgccgctgttcatatcaattatttttcagaaaccatggatgcattaccaaaatgtagataagaaatggtaacgaaagcacaacccaaggcattcattatgaggttagacagaacctctttctttggatgctaaagcaggcacctgggaaaaacaaaataccaacccaaaccctgaagaaatgtcactaattaattgaaggtgtatcactcaattcagaattgagacatctccagctgcattttcaaccagatgttctttcaggcatgtagtgtcactactagagagaaacttcaacagtcctgattctcataatgagtctattgaaatatcaggtgggaagccttccaggtgtgagatcacattgctaaaaaactggtaatgaggggcaattctgcttcatttcaatatttatatagcttgttaagggaactttctactaaagacacccctcggagtctaaaaaaaaatgcattaagtaggtggacaggggctttgattttccctccctttgaggggaggtaaatgcatagttccacaagcttagaatacaatgaatcaggtaactgagataatattatcttctgcactcacactaccacaggattcactttttcatgtatcatatatttgcaatttcccattgactagggtaattggcaattcctgtgagctaacttaaaaatctgtttttctctttaactaaaacatagtataaaatcaggatcaaatatctgttctgcaactgtggaaatggcttatttccagaaatgtttaggatgtataatagtttgtacccagatgtagttatagaacagtcactgaaaaatggttgttttcttgcatattatttcaacctcccacccatgttaattgccagtgacattttgggttgtttttcaatactttaatgagaactaaagcttctgaaggagtcttgctgtatctaccatctgattgaatttgatgtcccaattattgatgtctttgccagtctgtgaaggaaacccaacctccaatgggtgaagtagcagctaggttaggcagatattttatttaatttttagctctagcaaaacttaacggtaatgatcaagaatcttgtaagtatgaagtattaatcttgaataggcatgtttgtacagagttcatgtctctgtatctgaagacattagcccctagggtaatttattatgagacacactgaaatttaagttgtataaaaacaagttatcggaggaagctaagaaggcccctaggtggagcagaggtactaaaccctcagcttgataaatactgaggagggaaggtcattacaataaatattgcctactcaaaatgtgatccatggacctgtaggatgctgtagcattggcttctaccacgggcttgttagaactgaatctcagtccccctgctccccacagacctactgaaccagtttaacacattacccataagatttatatagatgctgcaaaactccattaacaaggggttgtggtgcacctgtgctcagcttgggctgtagagtaccagctggcatgataagtgaggcagctgggattctgattctgacactgttgatgctcaacatcaggtagggaccaggttggtgtgccacctagatcttgcagtttggaaccaaagatttcaatgaattgccaaggtgttgggtgcaaaggaagtcagtatcaaagaaagagaggttccatccatgtaggggccacactatggccaagaacgctgtcaggctttagttcattaaattcagggctacagaccaagatgaatgagtcattgcccattccatcaagacatcaggtgattaaaacatcaagataaaaatggcctcaagacccatccacacaacatgggttaaggcaagagtcctggggtttccctgaggcacatcagctgtcagtcttggggaccacatttcatattcttttcactagtgggaaagggtttctcaggttctcctgagcatacggcccgggtgacgggcttccattgagttcttaaagcctagaagacaaggattaatgtcccaacctattcagtttaaagtggaggagtgcagcaaactcaatccaaaaaataatatccctaagaaacagtactttttgaaggataggcatcccaaattgatattttcatgaatgaaatggggaaaaaatgataatgatacaaaatactaatgcaactgtgcggtttaagtgcagtcaaacttggcaggatcccatgataaacattcatagttttaatggcatctaaactgtagtaacaatcaacgagttagtaaagcttgaaattagtaaactcaatttgattcagagtttgtggtgagcaattctaatacttgtgtgttcttaaggaattacctttgaattttttcttttaaatatgtcaaggtcttaatagtattgactttctttgactgtattatctctttgaacccttgcgtcaacactgttaaataaataatcttagccttatgtttaaaattaggcttagagaggttaagtaactttcccaaggccattcagtaaagtacaactcacaaaaaccttctgaaaattttccaattgactctgtctactattccccaaggattttgaatctcattacttaggcctttgtgagttatcaaatcttttaagcaaaaaggttttctttcttcagtcacttattcattcagttacttctatcttacagggcctggggacctgtaggtaaaaaattgtcacaaaacaatgtttctttagctttgatcccattctgcagagaactctagtttttctccagtgccaacaaagcatttctgggaaacaccagaggttttatcctttgtattctgaatgaatcccatttgctaccacagattgtgtgacatttctttccttttatgcttaggttttctgtggtcactgtggattaataaggataaacaaaacttccaaaataaatacaaacaaacatgtaatggctcagtgaaacataagattatttatttctccctaatatagttcagagagcttccaggtaaagcagtgggcaggaagataggggttctctccacatttattaagggattctggatgatgtcagttttgccatctttaatgtgtgatttttaaggtcttcctgagggtcaccagtccaatcggctaaaagaagagaatatgaattgagtacatgtggggaggttttctggggccaggcctggaaatggtacagaggatgtcctcttacatttcactggctagatctcagtcacatggcaaacaatttctaggcaggcaaagaaatatggtttgccttgtgcataagaagaggaggaaatgcatttttcgtgggtagcttgtactctcagtgagactactcatgtgccaaatggaagccatggtaccagcacatagcagaggcagtcactgccactgctcatgtttataagatcatttcccctgctgacagtcatcagccaagactagaatgcccacattcaatgaaaatgtgaccctcatgcagctatctatgctgctgactccatgcctctaccatgttcagctgagcttgtggagattggaggaaatagacgattaaatgttcactgctgttttactaaagaccccttgcctggacatatatctaaatgtgtatatgttgagggattgtcagctgggacaggggtttaaacccataaaagtgttctgtgttgtcctccaaatcatgcttcctttctaatgcttgggtgaagcagctttggctcagacttagacacttgcttaatatcttctaggtacttgaagagcttatggcccaatgggactaactgatgcatatacaaaaaattacacaatcaaatctcaatttcctactgtttattcttcctttgttaatttctcactctcttagtttatttgaattctgctaccagtttgtctgtcccttccctttgaccctgttgtttgcactgttcttagagtcaagatttcagtgtcatgataaaggaccagctcatcacataataagagttgtaagagtagtgacccaagaacatataagggggaagttctctactgaagggtctgtgaaaatttgttgccccatggggctggaccaaagccttgctattgatcttactgaacaggtcactgttggtcaggaatgtgataaaaaggctgcagttaataccaacaaacaaatattatttgtaacatgagctcttgagattatggtagaaatgtcacagtctgtatttgcatttgattataggagctacctttatttataaagaagcatgctgtagtgagaattctttgctaggagtcagaattgggttcaagttactattgaccacacttccagtatgacctcaaagccattaattaacatttctcggctcatttttttttctgttaagatgttgaaataacacctacttcacaggcttaatttaagaatgaaatgtgataatatatacaaaacacttagcatagtgatccattatgatctctgttattactatcaataatttggaaaaaatagatacctacttttaagaaataccttcatttttgttttttattagccatgtaaataaaactatcaggtattaaatattacatactgacatatattgaacatatatgtctgttttaatacatatatatttctttaatatatatgtgtatatatatagttctttgtttatttttagtactgatgattctattataaaagttgtagacatttcatttacaagtcattttagacctttaaaagaatattttttaagaatgtgtaaaagccagactttctttgactagatgacttttattctagaactgatttttgttttatgtcagactcaggacacatttgatttatccttaggttgttttctgaggctttaaagtatcagagctgagtggaaaaatacttcttggaaaactgattttccaactaagaaactcagagtgatggattgctagaataatggctgtaatatatactgagaatacaaaggagatatgtagtctcttcaagatgaatttgggttcataagaagtgagtctgtgttttattatctttctgcatataagaaaactcagactatatcatttctgcacaaattcatggtagcccctgtctagcctatccagttttaatatggaacaataaataatataaagaatatcatggtaataagttttttgtgttctctaatccagaaaggcattgttgccataacaagttttgtaattattggagaaaagtacaaggatttctcaaaaatcatttaaatggtaacatttaaatgttaagcactgctaagatgaacctaaaacaaatatttaaatatctctattgttaatggttattttaaaaaaatttctcatccacactactggtgcttatagatactatagccacaaaataggtaatactaccattatgctaatctctttgaatacattagtttattgaatattttttatcttttacaattatttcctacatctagcaaagatgtctagattctagctgtagcctcttgcctctttctccattcctgggtcttacttatatacaatttctcttcccatggccctcagaaatttttttttagacccctgcatgttcttactttctggctgcatctgctcttatatctttttttaaataaggtgcctttggaccctaccatggtatcatggtcatcgcctctcaaaaaaaaaatctgcatttgatgtctttgacaatagaagaatgattgtatgaaatgaatatccaatttatttttctttttttcattttcctttttatttatttatttttattttttagagatggggtcttgctatgttgacaaggctggtctcaaactcctggcctcaagtgatcctcccatttcagcctcccaaagtgctgggattccagatttgatccaccatgccccacccaatttatttctcatgattccaaagtttatgcatagatgctttagctgaacaatagttccttctaattgaaaagaaagcctctaactcagctgacatggaacagtctcctgcatgtagtgaacttactcactacagagggattgatgctttcagagaatgacttaaactatgacatgctgtgatgagtatatcctcaagctactacgacatgtttattaacctctgttacccaattaggtgcaacattgatcagaacctgacttcaatagttttgatacttagtcttttagctctgactgctttagagtataaggtccttgaagataggattaccaccttataaaacagagttgcacaacatagcatgttagaaataggttggggccaggcgcgatggcccacacctgtaatcccagcactttgggaggccgaggcaggtggatcacaaggtcaggagatcaagaccatgctggccaacatggtgaaactctgtctctactaaaatacaaaaagattagccaggcacggtggtgggcgcctgtagtcccagctactcgggaggttgaggcaggagagtcgcttgaacccgggaggcagaggttgcagtgagccgagatcatgccattgcactccagtctggtgacagagtgagactgtgtctcaaaaaaaaaaaaatagattggaacttttagtcatattcgttcagcttgaattctagttcactagttgtttgcttttgggcaattcatttaactgctattagactagccaactagggacagtttttgttccttaagtttccaaatggttgagaggctcaaatgagaaaatagtgccaatacagttcattaattttatgattgtttctggcatagaaggaaatgaaatatttaataaataaacctatgagtgaattgatgaattaatgagtggtattcaaattatacttttaaatgtatgtttaaatacatgtggcatcccatttcctaggcctaaatataatgaacatgcttgcttgcaaaaggagccttttgctaacttcccagagagtctcatacaatcagtcagagacaaagacccggtagccgcttcaggagcctcgcatagcaagtgattcctgttgttccactttgtgcttaaagcatgagaagttgggccagagtagaattggaaatggaggacctgtaggccaggctttgcttttaggggacttgtgattggcaattcgttgcagataataatgagaagaaggcagaagattttaatgaggcacgcatgtgagaacctcagagactctgggtaacttcggtgtctgcaaagtggctactccctgtttctcaagataagaggggaaggtttttccatttcaaactggttgggctcattttggtcaggaagagtcttggatggagaaaaaattccagccctgaggaaaaggcattcagcagtccctggtagtaaggtaagggttggtagcttaatcaactataggccacacagaacaacaacaaaaaaggggctttagcggtatgtttttacctagtaaaagaaataatttcacttctcctctctaccactctctttaaaaactcatcctcacaggtgtatgtaagacaatctgagagtggaggccagtgttttgcagtgcaaatccggcagtatggcttgctttgagaagtctatggcaatgctccaagggaaaagactgcaaaagtcaaaatataaatatattcagtgacttcagatcccattgtttccaggtcccttttgctttttccaattacctgtctcatttttgaggaaactttgcagtgcttttccttttattgtcattcttccccccaccctgtggtttttctaacacctgcactgcatcatccttcaagacccttttggctttgtttctgtgcatgattatctccccttctccctccttaccatatgcgttttaacaaaaccaattttcagtattgagttgaaaaaccctaatttaaagaagtaaaagagatcttcccaaattttaagcaaccgtaaagaaccagctggaaatgtatacatgtgtgtatgtttgcatgtgggggagcagtgaggatgatctctagagatagattagatataggaaggatttggcaatatacatgaggttagcgtgagaggaaggtaagtttaaatttacagtagatagccatttccaaggatgtattagaacaaatgcagaatttcagaggaaagaacagataattatttcacggcccttgaaactccttgcacatttctagcttgtaaagagaatgcagattagctttttatccatacagtaccttcatctatcaaatatttctgtctttataaacctacaaattacatacatacaggtctgggcttctgggtgaattagaagcaggggcaggtttcctcataaaacctaactttgtcaccaatttcatgtaatttgctactaaactgtgcttcttttgctttttatctctcttcttatgtgctcttaaaagctacttgctggccgggagcagttgctcatgcctgtaatcccagcactttgggaggccgaggcgggtggatcacgaggtcattagatggagaccatcctggccaacatggtgaaaccccgtctctacgaaaaacacaaaaattagctgggcatggtggcatgtgcctgtagtcctagctactagggaggccgaggcaggagaattgcttgaaccagggagtcggtggttgcagtgagccgagatcgcgccattgcactccagcctggtgacagggcgagactccctctcaaaaaaaaaaaaaaaagctaacttgctttaatctatgaccgtgaccttacaatgtactttataatgcatgtaccttgatgataacatgtgatttgtgatctttctaggctgacaaatgaatctcctagagctctgctgtgttgctacagtggtctgagtcattgtgattagaaattatttaaattcatcatttttatagacaggcctgaacaacctagcagagtttttttaaaaaaattttactcaaaattaaatatcttattttgaaaactgtccttgtactataatagctagcagacgcttcaaatatttctctttcatgtagacaaatctatacatttctcctcagagaatatagatgtcaatgcctgcagataagcaatccaaataagtttaatggaaggcagttttatgtaattaagttgtgacacttttctgtgtggaggaaggcttaaaaggaaggaaaacaagccacaaatgggagaagggcaatatgcacacgaaggttgtgcctgtggaattgaacattccttatctatcctttggttcttcaaatagttcatatctcttggacacatgacattgagaagtctggtaaaaaagataaagcctgccatagagtagcaagagaaccaagcaaatgtaatgtcacagaagccaagaggagacaatttcaccatggagggatagaaggatggagtgattgtctatatcaaattatgcttagaaaaaagataagaacaggtaagtgaccctttgctttgtgaaatactgtctctggtgactttgataagagcccttttattggagtggtgagtatgaaagtccagttgaaaatgatgagaagaggccgggcactgttgctcactcctgtaatcccagcactttgggaggccaaggcaggcggatcacctaaggtcaggagttcaagaccagtctggccaacatggccaaatcctgtctctactaaaaatataaaaattagctgggcatggtggcgcacacctgtaatcccagctgctcgggagcctgaggcaggagaattgcttgaacacaggaggtggaggttgcagtgagccgagatcataccactgcaccccagcctgggcaacaaagggagactccatctcaaaaaagaaaaaaaagaagaaagaaaatgatgagaagaagaaaactgaaggtcagtaggtatggcagtgagtataatcaaattagtcagggatttttttctgagaataattgagaactaaaatagtggctacagaaggagacaaggccagttatacatatgggaggacaaaagtgaatatgtgggcttcaaaaggaatacacatttatttttcattttaatattagaaaaataggtagagataaatgcaagttggtggaacttgtggtggaaaggtgaggctcttttcttagtcatggatgcagctacgtcattagcagagaggagaccaaatagcagctggagatttgaagaggggatgagtgatggaattgtcatctcagagagttttaacgttcaaaccaagtataaagtacattaggtacaaaggcagtagacataaatttgtaaataagaatacttagagactataaagaactaatcaggccgggcgccggggctcacgcctgtaatctcagcactttgggagaccgaggcaagtgtatcattgagttcaggagtttgagaccaacctagccaacatggtgaaaccccgtctctattaaaaatacaaaaaatagtcgggcgtggtggtgttgcacgcctgtaatcccagctacttgggaggctgaggcatgagaatcacttgaacccaggaggtggaggttgcagtgagatgagatcatgccactgaactccagcctcggcttcagggagagattgtctcaaaacaaaacaaaacaaatcaaaataaagtgaaacaaaacaaaagaatgaatcaatccaaaccagaaatgacatggaaagtagtggtattagaatgatattaagcatcagttccttttaaatgtagaactaaaatatctcagagctgtccaatgtaatatgaaaatgctctctgcattctctacttataatacttaaaaaaatagtgatattcaggtgtcctctgatgattaccatatttctgtttacatgatctaattgattgttaagcatctagtataaatttgttgaaatttttgacttgtggatggcatacttcccttattcccagcacagatagagggcttgtcttatttttaagtgcctttgcctgtttcaatagctgtaagtatcagggggaaatgaacacagctagaaatctgcactcaagtgttcatcctgccagtagttgtcatttaaatcaatgattagattttatcttattgacgacacatattaacatgtataaattctgaaaaaaaatgtaataattacaatttccttaccctatttcaaacagctgaattgttttaatatactattatagtcctttttttggaatatattgtattgtatagttagacaaatttgaattataaataaaccagtatcttatttatttatttgctattttttgagacggagtctcgctctgtcaccctggctggagtacaatggtgcgatctcagcgcattgcaacccctgcctcccaggttcaagtgattctcctgcttagcctcccaagtagctgagattacaggcatgcaccaccacactgggctaatttttgtatttttagtagagatggggtttcaccatgttggccaggctggtctcgaactcctgacctcgtgatcctttcaccttagcctcccaaagtgctggaattacaggcctgagccactgtgcctggccatatctcatttatttttattttttttaatttttattttagatttatggggtacgtgtgcaggtttatcacaagagtataattgtgtgacactgaggtttgagcttctactgatcccatcaccaatatagtgaacatagaacccaataggaagtttttcagccgttaccccacatctgcctcccaccccttttggagtctccagtgtctgttgttcccatctttatgtccatgtgtacccaaagtttagctcacccttataaacaagaacacacactatttggttttctgtttctatgtcagttcacttaggacaataaccttcagctgcatccatgttgctgcaaaagatatgattttattcttttttatggctgtgtagtgttccatggtacatatgtaccacattgttttcattcaacccaccattgatgggcacctaggttgattgtatgactttgctattgtgaatagtactgtgatgaatatgctagtgctgatatctttttggtaaaatgatttagttaacattgtgtcatcagtattctgagtttgttcatacacttagtaatcactactgatatttgtaatgttgaatataggtttccaatttgtggctatcacaaaaattccaaaatgaatgttttcaggcaaataactttttcatgttggcattgttctttggttagatttttcttttcagaattgggagtactgaatcaaatggcatgactattgtcatgcttttaatgtattttttcaaagtgttctccaaaagctttgccatcttacctctactggcaatctattagaatcttaattttattatatcaatatcagaattggacatttggatgtatctgttggatatacaaggtattcatttcatctttgtccttaatttctcggtggaccttcccactgtctgctactgtaagaaatgcattttttaaagtatggtagatagagtgtggtggctcacacatgtaatcctagcactttgggaggtcgaggcggaaggatcacttgaagtcaggagtttcagaccagcctgggcaacacagtaagacaaccatctctgctaaaaaaaaaaattatttatatatatataactatatatacaaatatatatatataactatatatatataaaactatatatatatagttaactaggcttggtggtgcatgcctatagtcctaactattctaggagcaaagatgggagggttgctcaaatccaggagttggaagctgcagtgagctatgatcatgccactgcactccagtatgggtgacagagtgaagccctgtctctaaaaaataaataaacaataaaaaataaagtggtttgaacttagtatatgcaattctttttaggcattttgttattaaccaaggattaaatgtctagtccacagtcgactatccgttttttgaaattttcccattaatatgtttcttctctggcctactgggtttgcaaagagatttgtggtaatgattctatgcctgcattcttgatatcatgttctgtatcccatgcttgtttaatattcttactggaggtcaaggaatagcataaatttcttatcacatcacagtataatgctgttaatttcagggaagatgtaacatactaactgttaaagaatgatcctctacttatagtatgagtggaaattcttatacatagattatatttattaaattattatattattttcaatatactcttagctttgaagataagtaaaactcaattaagacctagactccaccacttcctagcttaaatagatatttgtaaaattatccaagccaggaaaaatgaaaatatgaaaatgtatgaaatacaaaatctatgtccacctaatatgtttttttgagaattgaatgagatcatatatgaagacccaagcgcagttcctggacacaataagtgctcaataactattagttatctggctctccattctcttgataagaaatggacaaggccattctcatatcacaattctgggatacacatgagtgaaatcctgcatcttgtcagccaacacaccttggccatttgttactggaggaggcctttggaatgacaggagggcataagagtttgacaatggttctgcaatgcttgcctaaggagacaatgagactcaaccaattccagtttgcatgtggcaaaataagttaaaaagttgaaaatttgagttgatgaataagaagtagaagggcagtcagtctaacaaattggtaaatgtaactagccctttgggtctaatgttggaatctggtacttggaagatgtgttattgttttgttatttgtatgtacattattgttcttccctgattcagtaaattctgtactagctatggtaagtgaaacagagggaaagcattggtgcaattttgccttcatgggaattagcctacttttggaggctagcttgaggtgtcattgggaatgtggctgctagagccccactctcgggaggcaaaatcagtcacatttatgtaactgaccccaaatcaaaaacagttactccctcttttttattcaaaccatattgtatcatgagtaaggttgcttctgtacatgtcctagaaagatactcctcatttgtatagtcacaaaggcaagagtctcaaaactggtcatctttgaatatcacttaagctttcttttatggactaggaaacaattgagcggaaacatgtggtcaactctaactgtagtgcagtcagaaatcccagtgtccacatttcctgcagggtctgccctagtactttccttttacttatgaccacccacagtttcacctttgaaagccaatgtttggtgtgcaagcgtaagcttaagagaaagaaaaagttgatgctataataaatttatttctgaaaaaaaaagtctcaggtgaagttatttttagataatatatttacttgttattcatgtgaactgtgttaaaaagttgcttttatgtaggattaatttaaatagaatacttggataaaatagataaaaataaaggcaaaaaacttgtcttttctctatacacatggcattggatttcatacaaatgttatgtttgaaatgaaagaatatatttaaaaaataatagcctttttaaagcaattttaggtgtatggaaaaactgaatggaaaacataaagagttttcatatgacccttaactgcctatcggttttccctaacattaacaacttgtattagtgtggtgtatttgttataattgatgggccaatataaaaacactatttttacctaaaggccatagtttatgttaaagttaattatttgtggcatacattctatgagttttgacaagtgcataatggcatgtgtccaatcatacagactaattttactgcctccaaaatcccttttgttccacctattcatccctctctccttccccctgaacccttggcaaactgatatttttactatctacatagttttggttttttccagaatgtcatacagttggaatcatataatatgtagccttttcacactggtctctttcaccttgcaatatgtgtttaaagtttctctatattttttcatggcttgacagcttatttctctgaataatattccgtcgcataaatgtgccacagtttgcttatccattcacatattgaaggccattttggttgctgtcacattttggcaattacaaatacagctgttatacacatttgtgtacaggttttgtgtagacaatttcaaactcatgtttgtaattaccaacgagtgcaatgtttggatcacactgacactatttgacttgaggacatgctatgaagctgcaataatcaagacagtgtggtactggagaaataagagacaaatagatcaataaaacaaaatagagaaccaagaaatagaccacaaaactatagtcaactgatgtttgacaaaagagcaaacacaattcaatggagaaattatagtcttttcaaaaaatggtgctgaaacaactgaacttaaacaggcaaatttctttttcttttttaattttcttttttccatgagctagtgcagatggcattgttttaatttcaaatccctattgtttattgctggtgtataagaaagcaattatctttcgtatattaactttgtgtcctgtaactttgccatagttgcccaattcacaaatagttctttactgaatcatgtcatctacaaacacaggtttttctcctcaatgtgtttacctttcttttctttctttttttcttgtgtcagtggattaactaggaccagtacattgtggagtaggagtggtgaaagcatacattcttactttgtttctgatcttagtgagaaaacatgtaatttctcatcattaagtatgttgttagctataggatttttttgtagatattctttaccagtttgagaaagtgtacctctagtaaaagtttttgaggttttatcatgaaatggtatgataaatattgttatcatatccattcatgatgttgaatagtgttaaatgctttttactgcttttactgcattatgatataatcataagattttttcctttaacccattgatatgatagattacattaacagattttcaaatgttgaactagtctcacataccagcaacaaataccacttgtttgcggtatagaattcttttactacatcagtgggttcaatttgctaatatttttgataatttttatatatttgtaagaaatattagttcatagctttcctttttcataatgtctttattgtgttttgatattagggtaatgctagtctcacagaatgagtgagaaagtattccttttgcttctactttttgaaaaatattatagagaatttatgagaatttatatttcttaaactagtatttctttaattggtattgcttccttaaatgtttagtaaagttcaccagtgaatccatctgagctggttgctttctgcttcagatggtattaattattgattaaattcctttaatagatataggcccatacagattacctatttctccttctgtgagttttgacatagaaattttcacaatactcatttattatctttctaatatacatgggattataatcatgacctctctttcatttctaataatagttgtctttctttttcttagttaaattagctaataatttatcacttttatgaggtttttcaaagaatcagattttctctgttgatttcccattgtcactttcatcaacttctgctctaattttgtatatgtcttttcttcagcttactttaaaattaatatgctcttcttttcttagtttcctaaggcatgatcttagactattggttttagatttccttttattctactatacacatcaaatgctataaatttactgctaggcactgcctttgctgaatcttataaattttgataaggtgaatttttgtttagttcaaaatattttaaaatttcttttgagacttcttctttgactcacgtgttatttagaagtgtggtatataatcttcaagtgttttgggttttccagttatctttactgattttcaatttaatttcattgtgatctgagagaatacttcacatgatttctgttcttttaaatgtgttaaggtgtgttttatgatccagaaagtgatttatcttggtgaatattctgtgctgtcttgagaatatgtattctgatgtgattgaatgaagcattctgtagatgacaattagatctagttgattgatgttgctgttcatttaaactatgttcttactgattccctactgaaaacaccagcacaaggttaacaagaattacaagcctgactttaggaaaaattagagtcaggcattggacagggtgtgctggtacactttgacccacttccctgcagctgctgcataacccagagtcacatagcacactaaccacctgctccttcattgttcctatagatagaatctctgacaccgaacatttttacccaaaaattgctaaaggtgttcttcatatcctgaatttcagcagaacagcagacaccaagcaatctgaaaacccccaccaaggaagtgactcagcaccaaaacgttgtttcttcatctccctgtcctgtgacttcattcctcacttcttgaccaatcagcaatcccacactttggcccatcacccatctaggccccttaaaaaacccatccccaaacctcttggggaggcagatttgaggttccctcctgtctccttgtttgactgtcctacaattattaaacgctttctctgctgcaactcccactgtttcagtgtattggtcagttactgtgcaatgagaaatcaaatctggaggtcctgtaacactatctgccatatctatcaataactgttagaggagtattgaaatcttcaactataatagtggattgatacatatttttatagtaattatattagtttttgccttatatattttgacactgttgttgggtgcacacactctaaggaatatatgtcttctcagagactttaccccttcttcattatgtaatgctcctctttatcactgataattctctttgctctgaagttgccttgattggaaattaatatagctgctccaggttgcttttgattagaattagcatggtacatttttctccattcttttacttttactctatctgtgtccttattaagtggacttcttatagacaatgtataattaggccttttttccccactctgacaatcttagtattttaattgatgtatcaaacctttgatatttaaatgatgatatagttggattaatatctaccatatttgttactgttttctatccattgctcttgttctctttttttcttctttctttctttttctgccttctctggttttaactgagctcataatagagttcattttcttcctcctctcttagcatattaattatacttcttttttcctgttttctgtagtagttgccctggagtttgcaatatacatttataaacaatccaagtcctatttaatataaaacaataatatttttttgtattgcaagtactttataacagagaagtcccagtccctcccttctagcccttataacattatgttcattcatttcacttttccatgagttacaatgaccaaatactttgccattattatcttgacaaactttaacctgacagatcaataagaaaaaggaaagattttatctttatgtattccttttctaatgctcttcccttctttttatagatctcagtttctgacttataccatgtaagtttcttgcaaggcaggtctactattaatagcaaaaaatttcttcagtttttgtttgtctaagaaagtcttaacttttgaagacttccattctgaataacaatgtcattggatacagattttagcttggtgggttttttgtttcagcactttaaattctttcctgcacagcttctgttgaatgtagaagagaaatttaatgtagtacttatctttgcttctttttatgtaaggtgtatcttgcttttttcaagatttttctctttgtgtttaacctcctgtggtttgaacttgatatgctcccgtgtagacgtctgtgtctttctttatttttatctttcttgatgttccctgggctttctggatctttgattttgtttctattaatacttctggaaaattcttgattattattgttttaaatatttccttggttttgcctctcctgctatacgaaatccctattgttgtggtggtaaattgtttggggagggaaaagttaggtttataaccctatggttagttaccattcttaaagtgagactgtgtctctgggctgtcacttctacaatttgttctcaacccctcttcccttttaggtgataaaagaaggctggagggagctggagttgggtattgcccttcctccaggtcagttaggctctggtaaaatagtttgtcttaagggtacgccttgttaagcataacagaaagctctgtgtatttcaaatggctacttcccctgccccctgactcacacacacaattagaagcaccaacatatttttctttaaaaaaaatgtatcacccctccccctcaggactgggcctccctggtgtttttaactctcaagcttgtccatactgagccttgaataatttgtcaattacagtttaaatgttcctaccctgatagccctcttgattttaatttaaaaagaagaaaagtactgtacatcattatataataatgtctcccttctttctatgaagagatctcataatcctttttttactaacactttaccatatgtgattgacaaatttatgacgttagaaaaggaagacaactttgaatgtatgcaaagaaagatttggagaatcaaagtaacatattcaaaagcatcactaataagctttgttagttccttggcttttgtttgtaataattttgtatttaattagaaaataacgtgattctatccttgataattgagtaaagagccattcaaagagtgccaatctatggaccaggttttgattagcactgatttggtatgtagctttattgaacttagcaactcttctaggcaagttcaaggggcctgcttacctctgtctgtctttcaggactacaatctattcagaggaaaatctcaccttttctattttacaattgctgaagtgtcattttctgtatcagagtaatggtgctaatcaattgagaagatcacaaaactttggattcaaacattaacaagttatattgtgccaacagattatattttccaaaaaaaaaaaagagagagagaaaattggaaaaaaaaatagttggaaaacatgtgttaaacctcataatcaatctggtaatagaattttcatgattgtaccaaaccttatttcaatgaaaagccaatgtaatgtaactacattaacattcaattattctttattcctcatcgtaaatttagaaaaggtcaaaagagtaaagaagaaagtaaaattaatgttatcccacaacccttgtatataatattagttttccatttatatcacaacaaattaccacaaatttagcaacttaaagtaaaacaaaattattgtctcatagacctttaggtcagaaatctgggtgtacttggctggtttgtctgcttagagtctaccaaggctgggcttttatctagaggatctggaggaaaagctgctcccaggctcactcagcttcctggcagattcacttcctgatggctgcagggctgaggtccctgtctccttgctggctgtcagccagaacctctctcaccccatcgagggcccctgtattccatgttatatcagcccctctgtctccaaaccagcaaccagggcttcaaaccctcctcacgcttcaatctcttctgcctccaatttcagtaaaagcgtagacttttaagtgacttgattgggacaagctggacaaactctctactttaggatcaattaattatatatgcagagaccctcttgccgtgtaaagcaatattcacaccggtttcagggattagagtgtggacctcttcaggggaaccattctgcctgttatcacattttaatgtccctcaattttaggatgtttaattcattaacatataattcctttaaaaataggaattatactggatatactggtttgtaattgactttttcatgaaacaatgactggcatcgctgcatattttaatataatgtgctcagtgttcattattgtccaagtgtcaagcccactgggatgctcttggctaagagtgaagaattccacataattttgtacccctaatacttaaagcacaaaaattcagaatgacttagcatcttaaaaaatctggaagatttagtgttggtcatacaaagtcacccttactcatttgtattcttcttactttcttgagaagagacaaagacctaaggtctcattccaggagttatgtatgactttgatctgaatgtcattcagggtatacatcttgagaaggaaaagattgagaagctttgctttactctaaactgagatatggtttttaatgactgtgttgtattcaattatgagaaaggacaaatattttaaccaaatctatattttggaaataattaataatatttggtaacaactcaatatttttttgaacatagatccttggataaggccaaaatataaatattttaatgattataaatatatactatgtagctgctatctagaatgaatattctactttaaattctcactgattttatacagaaacacctattttactctgtcatctccataataaatgatgaacatactttaactgtaacactggcagatgtcttttaaagatatttggtatcttaagtagttatttatccttagattgcaatgagttttcatcgaaactgaatttttcttcttttaaaattatttttttatttttcatttttattttatttatttattttattatactttaagttctagggtacaggtgcacaacatgcaggtttgttacataggtatacatgtgccctgttggtttgctgcacccatcaactcgtcatttacactaggtatttctcccagtgctatccctcccccagcccctccacccctggacaggccctggtgtgtgatgttccccaccctgtgtccatgtgttctcattgttcagttcccacctatgagtgagaatatgtggtgtttggttttccgtccttgtgatagtttgctgagaatgatggtttccagcttcatccatgtccctgcaaaggacatgaactcatccttttttatggctgcgtagtattccatggtgtatatgtgccacattttcttaatccagtctatcattgatggacatttgggttggttccaagtctttgctattgtgaatagtgccacaataaacatacatgtgcatgtgtctttatagtagcatgatttataatcctttggggatatacccagtaataggatcactgggtcaaatggtacttctagtcctagacccttgaggaatcaccacactgtcttccaccatggttgaactaatttacactcccatcaacagtgtgaaagcgttcatatttctccacatcctctccagcatctgttgtttctgactttttaacgatcaacattctaactggtgtgagatggtatctcattgtggttttgatttgcatttctctaatgaccagtgatgatgagctttttttcatgtgtctgttggctgcataaatgtcttcttctgagaagtgtctgttcatatcctttgcccactttttgatggggttgtttttttcttgtatatttgtttaaattctttgtagattctggatattagccctttgacaggtgagcagattgcaaaaattttctcccactctataggttgcctgttcactctaatgatagtttcttttgctctgcagaagcaaattcttaacgttgtatgtcttcctttcttccttccatcttgccttccttccctcattcattccttgatttcctcctcctcttttttttaattgcttttgtttaaaaacagcatagtactatggttacaaagtagatagcaagatccagtaaaaatcaatgtgatgttaaatttaaaataaatttgctattattctggatccccaaaataacaatattatatgtgactttataggaatataggaatgctttttgaattagcagaaaaacatatggcattaatgtgcaaggaagaattatgccacatactctaaaagttctcaaaattgatatccatgaatctttttatctgtgcagtttaaaatgaatgtctttttttcttttgaaaattattttactgagatatattgattttatttttgaagtactggagtttcccaggttcctttaaactttcttcttagatttgctacaagatttttacactgtcatatttttgtaatgtacacttgaaatacatatgcaatgttgttaagtctacatttcttgttttgagaatttgacattcaaaatatgtattagtgttctaaaatatgtttctgcctccaaagccactgcttagcatggctgggtgttacagaaaatgctgtgtggctgtgaagtatgaagcattactaatatctcttagaatataaaatgaatttgttttctaaagtcaatgtgattctaggtcctcagaatttttatatagctacttagatgacagagttgtagttaatagtttgagaagtaggttttaatatctgtggtattgacatagttgttactcagtagattacaaaaaagaaaaatcttgtatccaattagaaataaacattctgtaagaatataacttcccagttagtcttgggagatggcagttcaagaagtactttgtgaaatattctaaaggattaacatagttcatcattttatgcaatggcaatacatatattatacaatacattcctatttttactcatgtagttcttcatataatgcatctaatattttaagggcttatatctgtaatttgactaggtcatttgtttagttatatttgaattttcagacaatcattaaaaaattgtggaagggtcactgttttattctcttattattttaaaaaaaataattaattaattaattatttattttttccatccagagtaattttgttttaaagttgtaggatgataatatttttacatctgtcacataaaattaatatttttaagcaatgtcacattttgaattgtattacaagtcaagaaaagatgttattattttaacacatgatattttgatattatcccaaatagatacagttgtgatattttcatagtttaactataaacatattttaaagtgccatttatttttattttattttattttattattaatatactttaagttttagggtacatgtgcataatgtgcaggttagttacgtatgtatacatgtgccacgctggtgtgctgcacccattaactcgtcatttagcattaggtatatctcctaatgctatccctcccccctccccccaccccacaacagtccccagagtgtgatgttccctttcctgtgtccatgtgttctcattgtttatttatttatttttgagacagagtctcactctgttgcctaggctctagtgcagtggtataatcctggctcactgcaacctctgccttccgggttcaagcaattctgcctcagcctcccaagtagctgggcctacaggtgcccaacaccatgcctggctcatttatgtatttttagtagagaagaggtttcaccatgttggccaggctggtctcaaactcctgaccttgtgatccgcctgccttggcctcccaaagctctgggattataggcgtgagccattgtgcccacctggggcactgttactttaacaacagaccatgtggaccactttgttgagcactcatatttcatgggaggcaagtttgaaaatttttattttagtgcagatgtgtacagcagcattttccaatgagtttgacatggttatgctctgttcgaattatgtttgtttatttcacaaattacaggtgcagcagtataaatactagagctttatgccgctagctcagaattaatttttacaaattggaaaatgttaatacattgatttttaaaagttgaatttaacaagcatttatgagctctaattttgtgtattagaagaatcattaataaaataaccagtacttattgagcactaatatgtgcagtttaatgctttattaatgatttttttaacagtcaaggaaactgaaattaacaaaatataagtaacttgcatgaatttcagaagttttcaggtaatagaagcaagattcaaattcactttttactcagatctcacagtcttaacattattctactctactgctctagaaacacttgttttctcctgacccttttatcccattcttcacaaactgtcattctcaaatttcaatcttcatccaaaacccgtagaagggtttgttatataaaacacaggatattagactccagtcccaacagtttctgctagtagtttaggtgcatacctataatatatatttccaaaaaaaaaaacctaggtgatatcaatgcttcttatccggggaccatgctttcaagaccactgcctacagtttcccttatgtttattgataaaacgggtggtatccattgtttgagttctattactattctatacacctgttctagttaaacaagatttagacacctgtgagtccagatgtcactgatttgaagatgatattaaatattctagtaccttcttcaaatgcttgttaattacctatcacataaaagtcctaattgattaatttattactcattaactggcagagctgtttcagtcagtctagactagacatagtttgcgagtttagaaatgtattctggagaattgattgatatgttatctgattataaaaatagaaataaaagaagaggtctggctgccgagccatgtacatatctagtattccactgaagatgcatggaatataattgtatattcattataattgaattattgtatctattttttcattgttaatggtatattgtttctttattacttcacctataggctattggataaaaaatgtttactattgccctttttattttatactttgaggtaaagccatttctacaaataaacaatttcttgtagtgtcttaacatccccacgtggaatgttttttaaaaatcatgtagcttattctaaatctattctaggcaaatgttaaaatcattttagttagaaatagaatgggatcaggcttcagtagatgccattagaagtggtggtttgtactaggaaggattcttcacttctacatctgtttaataagtttcacactttaaaactcattttattatcacaactgaagaaagagatagtaaaaatgtggagggatctaataaaatctagccatataatatttggagagggagatgggaaagggaaggagagacaggtaagacgtaccattaaaacagacaagcacacgataattcatggatgctgattacctgaccttttcttgcagcagactactcctgtgagacaaaaaggctagtaagaatacctagaatgtactttagatattatttttgagcactaatatagttagcctcaatgataattgcttttaagcaggccacacatacgctacacacacagacaaacaaaacacacattcatccacagggatgactgccatgtgcaaacatacactgaaaaccttctccaaggcaatgtccttcaacatcttttaaaaatgcattttaattgccattgtaactggaaaccgtttgcactcaaaattaaaataatcttcttttgctattcaggatatcgattatgttatgtcctatcacttggatttaattagatgtattttttttccatgccgaaggaggtaaaaccttagatataaatactgaaaaacaagcaccaatatttcactcatccagaaagaagtggctttccacattattcgcttgtgtacaattcttttttcagtttttctatcttacattaaactcatttactcataacatatccaagctgaatgctgcttttggctagaggtaatggtgtaagcactttttcctgccttgttaatcccagccttccacatacaagaaactttatttgaaatctgatctcacactgaatattcttattcttatctcaggtgtcaacattatcccatgtcccatctcagagcatcacatcttacgtgatcatattgtgataaatcatagcgttctacagtatgttctttgtttttcttatagcattttattgttgtactgtatttgttaaaaactgtatcataatacgtaatgtctgacatcaagagatcatatctttcctgaactgtttgcttctatattctgtaccttatgtctctttctgtttccatcaatacctttcaggcataaggaaaagaaggacactgattttcaattaatagtctctggcccaaaccctctattaggtacaaatatattaaatagatcatttttctcaacctatgtcagtgtttcataaggcaggaattatttttactttgtatatggaaaaaaggaaaccctgagatgctaagtaaattctttggtttgttaaattgaatgtaaaacatatttctgggcatacgtattgggggattggatagtccttgttttttctgagtgcattggttgaggagaatcctttgccaatatagtaatgcacagaggctctgcctatgcaaccttgaagaccctccacatacatgcacacacacaccactcacacacacaccacacagacacacatacacatacacacacacaaacacaaacacacatcacacatatacacacaccacacacacacaccacacagacacacatacacatacacacacacaaacacaaacacacatcacacatatacacacaccacacacacgcacacatagacacacacacacacagacacacacacacacaccacacacatggcacacacagacacaaacaccacacacagacacacggccagccgaagtttggagaaggaggcagcatggagaaaaggggagtctgacaccagcgagtttgtgaggaaggggaaggccaaggacttctaggggcaccgggctctgacataaatgtctgttgggggtgaataaagtcctgctgtgtaaaataggctcctcttgaatgccctccatatgaagtcatcctatgaagtctaaaaagaaaatcacaaattgctaagaaagatgaagtttcttaggaaaaacaatgtcaaaatgagcaccttgtactgcctggcatgcagtcaggacgaagcagtgggacgcagtctcttaagtgtggggccgtagtggaagccacggccagttggcatggaaatcacttcattctctgagccacacagaaagtatccccaggtcttcaattgtgttttgacagctacggagcagctgtctactccggcaaatgcgtctaatgtgctgtgaagattccttaattctgataattcactgctcttataaaaaagtcatgtaaaataaaatatcatttagggagagaatgtagcttctcatgaactctggtgaggacccatttcctggcctagaagttcacctgtgatctatgtcccctgcccacctgggctgttgggacttctgtgggtccactgcttacccagtgttttagacagatttcctccaaattgctccattttctctaacagccctagcattattgtgattaatttgactgcaattgagttttattacgagactgaaatttgtctttgactttggcagggaacttgcctctttgtcatcatcatttctagccagccagccggagctgtggtgccagacagtgcaagcgacaatcagcctacccagattgaaggtgtgtgtgtgtagggcctgcagagagggacagtgatgaggcagggagacgggggggaatttatgcggggagttggtccaatagtcattagaaaatagtcacaggaggacaatccaaagttgaatgaagtaagagcatcacttggtgactgacagttttaattaattcattaggaaagagtgtacctaaattatcttgtaccatacctgtctcacactgtctatcctgagtcaaaccaattaaacatttaaacataaaatagggtgatatttcattaagcataataacgtgcatttctcagctcaaaaatatgtcatatcaccaaacgttgcagaaaaatgagcaaatgaaataaatatggaatccacaatagaagaaaaattataaaaaatatataaaaacttccaattccaaactttacagaaattgttaaataaactatatttatattatgaaatgttaattattcattaaacccccattttctgaaaattatggtgtcataattatataatgatagtatgatattgagtatgaaaagtatgatattaaatgatataatgcaaattttgcaccctttttatggacgtgtttaaagtttgtagcagtgcaaaattttaacatatttctttctgaatggaggtaataggagtgatttttttttttatttaattttattttgctgtgatttctaccaggataaaggtgtaatcatgtatacttagaaaaaaaaatttaaattcttctgcaaatccaagaataagtggaggtttggcattaccattagagatttttatttttatctatcatgttgggccaaagtattactgccatttttttccatttatattttagtatagttccaatatttagaaactcctttaatgtaagttagagaaaattggacatataatatttaggaaaaagaaaatgcagtgtaaaaaataaagaataaaaaagttttctctagaaagcttgaaatctggcaccattatgtgaatatggggcaggggagcctttaataccagtgtgagctggagagcaggaggggtgagcacaaggcttgataaagaactaagactctaacccatacattctgcagcaagatttcttctgatctttatgttcctggggaccatggaaactagccaagggattggtatttctgcatgctaaagtgtagcctcatgcaaacctttaaaaagaaaaatacctgaggaaaaatgtgaaatttctcaatttcagatattcaagggcttcctgattggtctccctgagatcactcaccttttcttggatgatcaatattacaggataaattgtgtttcctaaaaatgtttacattgaagtcctaatctccagtgcatcataatgtgactttagttggagacatatgtttaaagcggtaataaggttaaggtgaggttatgagggtgagccctaatctaatatgactggtgtcctttaagaagtggagatgaggacacagacagacatagaggaaggatcgtgtgaagacacagggggaagacaaacatccacaagccaaggagaaaggccttagcagaaaccaatactgctgaccttagacttctagcctccaggaatgcaagtaaataaatttgtgctgcttaagccaaccaatcttggcagtttgttatggcatccctagcaaactaatgatgcaggagtttttcttaaccccttcatcggacttgtgacacggatgccccatttacttggcctgtcatgctcaacctcttgtacaaagaatgcactttgggcaccagcaagagcaggcttcatgtggaccctgaggcgatggtgcctaggtgggggtgcctgcggcccccaaagccccagagggcatattacaatgctctcttagctccaccgtctgtggacattgttatgttatcagctcagtgggcctcttgccttgtcgcgtggggctgctgctgtccaccagtgagggcaaaggactagtgtgacagccttttttgggtacctacacttggtgggtcctgagctcttgtccagcgtccaagaagaatgaggttgcacggacacttgaaggataatggaggtagataattttattcagcgaaggaaatggctctcggcagagaggggagctggagaggggatggggcaggcagataatcttccctgaagtctggccctctccggctggctcttccccaaagttaagccatctctcctctgaagcccagccatccctctgaagtcaagtcacttctctccagtcaagctgcttctctctctctaccaaatgagtctgggtctttatagggcacaggatgtggggcagaacaggctgtagatagttttggaaaaggcaacattctattggtaaaaagacgttattcaaaaagaaagaatcaggagagaatgggcaaacagggatagaagttctcactttgggccacaggtttcaggcttttgacttgatggtggggtttcaccagggactcacccacccctgtctgcccagaatttctgtttcctgcctctatcattaacacaaccaccaagccatcctattcacctctgccttataaaaatatgaaatactagctcttttcctgttctaaaagtgcttttgactggtctctgtggtctacagattaataataatctctatatgcttattagaattggcattatcaaggatattacatatatatccttatttagtatttataatatcttagtgagatagagattttaaatttcattttagagtaactgagcttaattaattgcccagtgtcactatgaacaagtctcccagtgttgagatgacactttcattttagtttttattattcaatgtgtaaattaaaagagttggagtcttgaaggtttgcggaacttgaagtattgtcttttcaaggttttcctattgtgctagttaaaatacttattgaccaggatgaagtcagacctgctgaagtttacatcaaggatggtggagagaaattaatttgtgggcctgtctcatcttctcctcaacaaaacccagtatgggggtcttggagacaaacagacctggggaaaattcctgctgtaacaactgaccaactctgccatctggcacaatttctcttagctgcagttttgaccctttaaactgagaataataactagtttatggaggtgtgatgaataaatgattggctgcatgcaaaacagcagagtgaagtagaataagcagtgcgtgttggctgttagtatcatctgatatcatgtggggatgatcaaaagacagagagcccactaaaaagtactttctcaatgtctataaaaggtaattgatttaacttgaaatagtttagactggggggagatagtaaaaatatcatttcatcttcctcatagacctgagctgaagctacccttactaacctgcttttgtgacggaatcaaagcttacttaattcccaaggtcaggcagctactaactggtacagtaaggtagccaactctggcaaccgagttctacattttcacagctacttcagtcaaatcctgattcaaggctgttaactttcacacttctcaagtgtctgtcttgtttcctcagaaccaagccagtggtagataacgtagaaaccatgtaataaccgtaattggcaaggcttcacttttcctacctcaagttacatgtcaccacaggatatgcaaggaaaaagagaattttccagttccttttcccatctgggtcagggaatggccaaaaaatgatcacagctgagaaatttatgtccatgtttaacatccttgcagagcctactttgcaaggaggtaagactacctgttgtcactggtattttcttttactaaaatataatttcacatttagaagctaataaggacctgaaaagttagctatgctatttatcataaaggtaatactatttttttgcagtgatggtgcttcctttcctgattttgaagtagattgtctctaagaagagaaatgatattcccctgaaaatcatatggccttcaggaggtgggggtgggaggtcatgaggttctttggatttgtgggaaagacgcaaagataatatatcaaagaagttaatgaaaatcatttacccagatgtgtttatcaaagatatagtgtttattcattacctctaccacacaccccatttcaaatcatttcttaaacctaaaaacagaaattatacacgcacagacggcctctaacttatgacggtttgacttaccatttgttgactttaagatggtgtgaaagcaatacacattcagtggaaaccatacttagaatttttaattttgatgttgtcccaggctgtcagtaagcagcaggatactctcatgatgctggcctgaagcagtgagccacagctcccagccagccaggcaatctcaagggtaaacaactgacactacactctacagtgtgttgccagtgtgtttgtgttatgtatttctgcaacccatcatgtctataaaacatccatctgtggcagtactcaacacattattataaaacaagcttcgcattagatgatttcgcccaactataggcaagtggaagtgttctgagcatgtttgaagtagactagcctaaactgtgatgagccataggttaagtgtattaaatgcattttcagtgtgtgctattttcaattttggatgggtttttttttttcaggacataaccccattgtaagttaaggagcatttgtattatttttctagcccatcatctctgccagatattttttaatctttgagattcccaattttatttgactatttcacccagggtaccactaatcacaatggcaatgccaactgaattcaggcattctattgtttctctttgctctcttttagcaattaaagaaggatataaaacttgatactttgggacacttcgttttaaacttcgggagtaggacttaaggattctgaagctgaggtggtaacagctatatatcctgccagaattggtctctgagccccagcctgcttctccatcaagtcataaaagtgtgcgttctgtgtactattgcctttaagggtctgtctgaactacttctcccagaactacttagttcatttatctcttctccagtgtggactctgaatcagatttgctctctgccttgttcccaggattttcagatttttacttgcttctcatttattcatccatcccacactttggcattttctatgtgccaggcattatgatggacttcagggatagttacatggctcaacaagatagacatggacccagtcttcctagagttttcagccaaattgtagtacctgtgagacagaaaagcctagcacctcttgcaaggcaggaagcaaagtagaggagacagaaatgtgcaatgtaaagccttttccttccaaaataaggagtggaatttgaaaataattatgacatttatttttaaatatatagtccctacccagtgttctgggatatatctttgacatgggcaaaaacaaaaacctcagcttcagccaaaacaactcattctatgcccctagtctagattattgcattttcttaccccaaatttacatacaattcttcttccagagacatgtatgatagggaagggaccccagaatgcttcctgttgccagatcaacactttcaaactcctccttgccctcctctgaattcttctagcgtaactgccatagaaagcatgctaaatattattgctttgagacagaaaaacttggcatttaattttaacttcaccactctacttaatacctctgggtttaattttgccatatgaaaggccaatctagataagtggcacacgtttactgcattattgtaaaatttaaatgagataatattcataaaagccctccagcagttaatatgtgtattatttctttgcttagtatgacttgaaaatagtgaaatctgtacattttattaaaaacaacaagaaaaaattccctgctttcataacttgccagttttattgacttgctgtgtaactcatggttgaaacaatgcagatttatatttaaggtagaaattctcttttgctcatttcaacctaattacaccaaattttgccttccttcctttttcccccaccttaaccattctcctttttcccttgtggcaaaatctaatgattcctatctttaatcatgagcaattaagtcacagtggaatatctctttgcctctggaatgcatggtaacctcatactctgacttatgaaactggaaacgtaaattacagcataaaatatttatcaattaaaattgtgttaatttttttaaatccaggtaatttttaacaacttttattccaggaaattataagtctatatttgctatggtttctaccattaaatatatgtatacacatatgcatacatatatatatatactatatacatatataatatttaatataagtttaattttacaatgaacccaatgtaccaggttggtgctttttaatgagaaatatatgtaatagaatgtttaataaatccatgaaatattaaacctaacttagtacttgggaatcttaaatccctcattaattttaagaaaggatgataaatataaatatatatatatattttatatatatatatatataaaatgtgcttttagtgatgcattatttgagccttaatacatttaaaagaatggctagaccagtgagcctaaaggacgttaaagatctttcctattctggatagaacagaagtgaagctgatgcatttttcagtgtctgttatctaccagatactgtgctagtggcttcataatcttggtctcctctaatcttccagcaaccccattttaaaatgccaaaatagccacttaaggataaggacagcagcatctctcaaggctaacttcctctctcatacctagtaagtggaaaaacagaggcttgtatgatatttaaacatagcctatgcacttttctatttcctacactgcttttagttagaaaagaaaaaaaaatgatcacaaatcactggtaaacatctgcaacatagaataatgcttctattatccagaatttaattaaatacacagatactttttttagtaccaagttggtttatgttagagtgtaactaatatgctcttcatagaaatgcagaaagacaagtggttaaaactatttgtgtaaaacatgatattatagccttggaagtgagaatcaggtatgaagcaatccttcttaatgtagggcccagctttgcttggccactttagagatggagtgtttcagtccttgtccttgttttccatctgtctggtctttggaaagcagaacagatgtaaatggtagagttctgagccattcaattagatttcatgcaccactgacccaaacatttctcctcaatcttatctgagttggtggcagatgtgcagcatgtcagaaagcattttcaaattaaagatggaaacatattgtatgttggttgatatggtcacaatatgtgtaagtggtaaaatatgtcaccactagagcaacaactatgatgcaagaaggaacaggaaaaatgggcatttcacatttcctttccttattatcagaagacaagaaagtataatttgtcaaatgtgcattggaaatcatgggcttcctgatatgtaataaagaccaatgtaaggctaattggattggactctgcattctgccatttacagggcttaatcaaggcatcttggtaatagagctgagtctgtgatgatttatgtagatagggctttgccatcactgaagatgatgagacttacactcagggaccctcatcattacccattcactcagcctcacaatccatggctgactcaaatcatgttgtgaatcagctaattaacaatgagatccttgcacttttatagatgatcaattaatacttgtcaatttattaagtttgcttgatgggctttagcaggtttcttgttgaggttatgagaacaatgatggcatagaagagagaaagaagcaaatatatatgtagataacctaccggctgtatggaccctgggcttaatggagatctcagtacaccctggggaaaggtgaggcccaataaaggcttccatactgaccatgaagagtgttttgaacctgatccaggatctgaagttctgaaatcacccacatattgtgtcattatcaatgagagtatacaaagaacagtcaaaaggaaataaacccatgcacaggtgttacctaaaggatttcttctcttgggggtaagtgtgaattcacttgagtagagagcattacctttaaaaattatagattaaaagaattacaagggatattacaactaattttttcttctttccattgagtgtttgggacccatttccacaccctgcaacatacacacagaataacttttaggtccatttattcccaaaatattgaatttgatgtcctctaattcctgactcatgacagtcaagagcagaggcccgtacaaaccaatttcttggtacctctcttcttcctggttctgccaatactgagtttcctctatcagactcacagttgacctgttaacataggtcatgctagtttcctgtaatattttcctcctgctcaaatctggtactttccacacatttatttttctattatcagctaccttgagaaagacaggagatcatatatttagctatttagctatttttttttttaccatattgatgttcattgtagtttaaataactctacagtggttgcattttaataaggctgctcctgacaacagtcctgaccgattttggaaagataccaaaaataaaaataaggatctccagaagtcctgtggactctgtcgttggagctggagtgtgcctccatccgtagacttcctgccatggtttccttccagcacattttcttcagggcatggaggctgaaaatgcctgacttctccatttaaatcactttaagcaaaacacagattatttaagcatatcttttgcatcctccatgcccagtagtaattttgcaaaattactgggaatctatttcagggcaaacttggcatttaaattaggtggttttaattagcatcttgactgcatgcagtcaacagcatgaagagaaggacagggaaaaatcacatcagcttatatttttgctgtagaaaaaaataaataaaacaataatatgctgaaaaaataacctcaaataattcaaagcaagatggctggcaattttctggaattagaatgataaactttatcatatattgaaattgttatatactgcaagactccttttaattatctttaccagaattttcataaagtttacctttcttctacacaaagaggcccacagacagtgccattgcagttattctaacacaggtgccaaatggactctcacatacatcccttccccctccactgttaaatattacccatcattcaagccatgacttaaaaactcacttctaggttatataaaggtaaccttagccacaaatgtcatctctctgtagcttgagaactcccacaatattctcatacagtcatatggcaaaacaagaacaccaacaccattcattgtttaccagttctaggcagtacaatctcagtgcttttccggaattgcctcatttaaccttcacagcagccagatgaggtgtgtgctactatagtgtcccattttacaggtaaggaaacaaagacgctttacaaagtgtaagtgtcttgcccaaggtcacagctagtaaatgggagaattgggtttgaactcacagtctttgcaccacacactacattatattgtgaggtggagagagtctctcaatatcatggaatatgttttacatattttcatgtgatttgaattttaaagatagtgattggaagtgaactatgaataatttcattttatatatattttagttatcaaaacattgccgttaggctttttctgcagtaaatgattacattacaaagctgttcaggagacgttatttttttaatcattctctagcatatttttccttttgtccttttatactggtaagaacatccagattctcagatgggcttagctgcagccgtggagtataaacaggatggaaaaatagggtgttaaccattatttgagttggctctcaccatcccatggaactagaagcaatttagaaacaggtggccacagagtttgctcaagaaagtcctgccaaaccaagatagggactttactgacttcttcttactctgctgatgccactgtacagagctcagatgaaccttggttgttgactttactgcaagaaaaaaaaaagcggttccacatacacactctttcaacagcttgttgaattccaggcacactctgggaagcccttagaagtgatgacctcatgcagagaggaggctggaagctctgtcatttcaggaacagttacggaagtaggagtgcaattgaaactttggggactttatttaccactgtattcaatgacttcaacagcttcaatatggaaggaggatttaatttcttttgtgcaggataaacaagagaaagatctggctcaatattaagaagaatataaaatggtcacagagtgtattggaaaaagcacagaaatttattcagaacacttgattctgaactgagaccctggtcttgctgctgtcttcccataaggtttttctgcttagactttctgaaattcatttattcaaatgttaagtgagcatagtaatatctatcttttagatttggggaggataaaactactgaaagataaatcagttagcatgcatactaacattagggaggagcattcaagggatcagtacaggctgtgcaaccttttcccagtattgtcaaatgggaattcaaaaatccaataaacctgtaaaattgcttccaaaacagggactatgaaaaatgaaaatgtctaccattctccctgaagtccattaagggattcaaatacctataatgacttaaataagtttctttagtccggatttaggaaattgaaggttgaagtacaaaaaaagaaaaagaaaataagtaatgtatgcattttagtattatcttctggaaacaatttcttaacctgtgtgaattgcacaatccttgaacatgtggataccattctggtcggtaagcaagatgcagagtgctgtaggtgtgtacattcttaaatgaaacatacaccagtgagaagaatatacaggagagacagaagtatttctatccatggtagaactttctaagcaagttacccccaaatgagcatcctcctgaagtagtgagtttcctgccatggatgtatatgcttgagttaaaaattccttgagcaacccctgggtagggaggttacacagagctttcacatacagatgagagaattgaagtaaacatggattttgaagttcctttctaccatgattccattatacttcaggactttaaaatggggactagttgggatagatctgtgaagttaaaactgaaggaaccttcagatagtcttgacaataaggacagaagtcagaataaaatgatttcctcaagaatacctttgcctcctaaagtcagccttttttctcctctttgtgtatgaagagaaagggagtgaaaagcagatgtcccaatgaagatgtgattttgtatcattctggggaactgacaccaaagggaatccagggacccatggaccaggagccaggattcaccttcttccccagcaataaaaggggtgggagctgccagcaactaaatcgcagtttccagccagggagtatggtggcaaccatgctgcctaatacaaacaatgggtttgttccagtgcacacctcaagaaatgtatttaaattccaaatcccaaatgaattcggaataagaagaaaatgggaggcgccaaagagtaaaaagtcagagaaaagtaaataaagaggtaattttagagaagaacagcaatatgaaaatcttttcaagatagggttgtgtaaccaagcatttgtggacagggtgaggcaagatatatatggttttctttttttttttttttttcagataaaaatagcagtaactaattaagaaatcctggatcataaggaaaagtagaaagaagataagtcagttctagtcctagcacctaaacagagctactgtttatctttagataattcctttccaccagttattttcagtgtaagaattttaagttggcccggacgtggtggtgggcatctgtaatcccagctacttgggaggctgaggcaggagagtcacttgaacctgggaggcgaaggttgcagtgagctgagatcacgccactgcattccagcctggttgacaagagtgaaactctgtcaaaaaaaaaaaattaagttgaaatagttttaatggccaattttatatttaattttcatatgaatctagactatttctcttggttattataaacccttcaaaaatacaatttaatggctatgtaatattccttaaatagatacacattaacttattctatcttctgattgttggacaacaaggtttgctttcattgtttttactattcaaaagaggttttaattacatttttgttcacaaagactttttttctttaaattatactgctagcctgggattattgagtgtgaatataattaaagttttaatatacaatgttgcaataagttttccaagtgtcttcagatgagcaaaaacagtgtatgccttttatcacttctctgaggcagggttttggttgttactgtaaccttcttttcaggatgaggtctgggaattagtcattactctgtctgctgagaaaaagaacctatagcactttacagaaagctgctaattaatccttccaactctctagtgtgggaaggaggtagaaatgtctccactgcagtatttactaagaaatattgtaaatggatatgacagacaccaattcaaattccccggatgagggagagccgtcttgctagatgatcatgacttctgctaaaaacaacccccattgactccagaggtttcctagaagattctgggctgctgcatttgccatgcccatcgtctctatattttgaactcatgagaacccttgggtctagttcgggattccaccctcttccgaagagatacatacagtctgaaagtaatgataaaatttactaagtctttcaggcaatgtttaaaatttgtgcctacagtttccttcagcttttgtttccatttgactgtgggcatccccagatgccttcagccgtggttttttttttttttttcagtctttgtaatagctaacgctgacctccacgttggcactgaatttccttttttgatctcatgttctcataaggcaagatagccccatgcagcctctgatagggttcacgtgtctttgttagttttgtttttgtgatttttgtttgcttgcttttttatttgcaagtaattccacactgaaaatttaaaaataaaatttaaaaataacacccatggccaggtgtggtggctcacacctgtcatcccagcactttaagaggccgaggcaggcagatcacctgaggtcaggagttcaagaccagcccggccaacatggtgaaattccgtctctaccaaaaatacaaaaattagctgagtgtggtgccaggtgcctgtaatctcagctacttgggaggctgaggcagaagaatcacttgaacccgggagacagaggttgcactgggccgagatcacgccattgcacctccaacctgggcaacaagagcaaaaccctgtctcaaaaattaaaaaataaaaatgtaaaaaataacacccacatatccttttcccagactcagctattgataacattctaacccatttacttcatcattttccatctaccaagcgactgttcaatagctaacatttttttctgatccataaatggcctttgggcatatcgtatactctgggctactatttcatagacttgaagatatattctgcctgcatttagttacataagacatccaaatgctttctcccaggcccctgatattacttaaaggagtcagattttatagctctatgagctcccctttacctggagtgcttctttttatttctagccctttttttaattacactttcagctactgcaaatacttactcatgtttcaaggatcagctcaaatattcaattttagggactttctatgaacttttccctggcagaaatttcctttattacaactcattatcgtatttcattttctcctgtgtgtttttttctggtagttggtaatcttcgcaaaagagaaggactgtgtagtattatataattttccttggtatctagcaattagtttagtaaatgccatgttttaggtaccccaaaatacttgtgaatcatagtaatataaatcgtctgtctttgttcatttacgttattattaattattttgtttaatcttttagtttgcttttcctcttgatgattgacttggttcatttaataccccattaactcagctcttactctaagcaagctgctgtgatagttgctcaagtgggaagttacaacagttaagaatgcttttggctgcaacacaagaaaatctatagttaaggtatctggatataggtgatttagtctttgatgcagtggctcattgatatcatcaagttctcaggcttgtttgaccttttcactctgccattgacaggtttgttaactcatggtcacaggatagctactgtacctccaagcatcacattttcatctgactgtgtttaagcaagaaatgaagaggtctgggtaaatggagatttctttaaattggatgaaaattgttttccagaaatcgtccagaagacttttccttatagtgcatttgctagaactgggtcacatatatatgcttagtggcaagaggtgttgggaaagtaagtacctggcataggaaaatagaatttccaagactgttttaaaataatcattaatcatatctggattgggtccatcatcatcataaacaaagccaggtttctctgagcaaagaaggggagactaagttcttggatagaaatgtcaagttgtacgacacagtcacaaatcaatagatcatttcagaactcaatccaaaactcatatgttccaatagagttgggagggtgaaaaagcggacaagtgtaacgccattaatcatgatctggagggtgagaagagaggagacagatgccccagatagatataattagtattagtgcagtccaccaagggcttaaagtgtggcccaggagtcaagatgtccaagcatcaggagtgtgtcagcaggctgatgtttacaaaggttaggactttctaccagcttatttaaagtctgttccagcgagctctgtttccacgagacgttactagaaaaatggaggctgtagccaagtttgggagatgggctatttgacattaatgtaccaaaatgtacacattttaagcagaggttgtagtggtcagtgtttctgaagcttatttgaccatcaatttttttgtccacagaaaagccaaatacatttggtaagtgttgtgtgtccttaacagcgaaaagagaactggcaagaaaaaggtgaaaggccaatcagagaaaaagaacctgaattttcaggcagatttttaagaaagatattaaaacattgataaccaaagttcagtgatcagaacttgggcatatagagattatggttcataaaggacaacgggcccatgagatattagcagcatgggcctttgttgttggatcatctgaacactggactagaagaagtgttcaggtgaatcctctaaattgtagaagcaattttccaagaatgagccatgttcaaggtaaaagtggagttatttttttgaggggagggagcagtgcaatgcacagggtgtccagtcatgactggaagatcaattaaaagcagaatcatggagagtagaaaagggtgaagaagacacaaggcaaggcttgataatgtacatgtacacatgtgtttatgtatacagtacacagaagtatgtatgtatgcttgtattacacacacagaaagaaatcactagagtcccatattcattatttatgttgtgatcttcagaagtttagaggtaattaaaaatagcatgtctagtttcacaataatttgggagatgcacattttttaaaaactcaaattaaataagtttgttcaatatttttagagatctcatgaaatagacccagaagagagccaatgctttcctctctaatatgtaaacatatcttatttagagaaatatagttagaaagtctggcagaaatcagtccaatggtttttcctgaaagcaaagtcaactattgatacctagaaagttctttggggaaagtgtaaggaaccagtaagtgattaaagtacatatttgacacatgttattcaccacatcattaattactcacttttcctccatatgcaggtcagatgatggttggatagagtgttggattttataatgttacattgttataaattgtaggggtagaagacaagagaagccatcaggtgcacctttctataaatgtgggttgggatgaggaaaaaggaagacagttgtgaccaggttcattgggccttgagagagtgatggtatatgggttagcttgaactaatctagaaccttcttcttaacaattaacagaactagaaagaatacttatatcttttggatttataaaggcgatcataaaataacttaaaaatacttgaagaaaagacctgaacccaaatggcttcatatcaaactacaagcaattcttggttaggagaggctaatacagtgcatcaaacctaaaccactctgcagtcttttactaccaccttcgtttgatcttctttcatcttctttgtcccatgatttctattctatctcattctgcaggcatcagaacccacgtagttatttgaaaggttctctccccataatctaaagactccagcttgactaaagttctaaagctccaaagaccccaaattcaagagcttttatgcttctttagcttcttttcttatttttggattctgtaagaatacatgcccatgatggagttgctgggcaggctttccagtccccaagaagggacatattcctgtcttctgagggtgctgtaggtcttctgttgggctgggggaggattcatggtcttacttttggaggggaaaacgccccttcttatctgagctccattttttctcatagacaaaagggtttactgtcattattattattattgttatctgtcctcgacgtagcagaagctaaatacattttttggtttgaaacaacaggctagacatccatagtattacttgtagtgcaccaacataaacaataccaaactagaatgttctcttctcctttcccttttcttctcaaataatgcagtcctgaagacataatatgagacattgcaaaggctgtgttcaggatgattgttggtgctgggcagggaggctgcagtggactaggcttgggctttggagcccaagtgagaggaaaaagtaaaacgtttatgaagtaggaaggagattgcctggtgagtggtgtcagagttgaagtgggtatgggggtgtccatatgtagagtggcttcgtgcgtagtgtcaaagtccaagggaatcttcatggggaaaggagtagtagcaacaatggaagattggttatatgtagtaatattaatccataagtaaatatattaaaggcagtgagagccatgcttctctttggaggggaagaaaaattgcaaataagagaaagaaaactaggatgaacctttttgtatgagactggaattatagccattaatctgaactcatggttttcaatatgtgtgtctatctacatatgtgtgtgtgtgtgtgtctgtgtgtgtgtgtgtgtgtaaatatgtgtacaggcatgcggtgtgtgtgcattccttagttctgtcaggtgagagagcctgggattaatgacactccacatcttggcatctaaataccattcttctccaaaagaaaccagtttgtcctggagaaacattagtttgcaagaaaagtacaagacaagccaagcctggaatgtctttttgtaccagaaagcaaaggagttctcaaaaagaatgatgagatgttcacatataagtgagaccatataatatttttctttctgtatctggtttatttcacttagcataatgtactccagggttatccatgttgcagcaaatggcaggatttcctactatttaaaggctgaataatattcagtttctttatctatttgtcctccatggacactcaggttatttccatatcttggctattctaaataatgttgcaatgaacatgggcatggagatatctttatgaggtggtgattttattttctttgagtatatacccagaagaggaattgctgggtcatatggtaactctgtttttaatctcttgtgggctgtgtgtgtgtgtgtgtgtgagagagagagtgtgtgtgagagagtgtgtgtgtgtttgagatagagaataaaatagtggctaccagaggcaggattaagggtaggaaatggggagatgtaggtcaaaagatactaagtagcagatatgtaggatgaacaaatttaaagatacaaagtacaacatgaagactatagttaattatagtgtattgtattcaggatttttgctaaatgactagattgtaactgctcctgccacagaggaaaaatagataactatgtgagacgatttgtttcatgatagtaactgttatactgtatatgtgtagctgaaaacagcatatattatgccttaagtatacacaataaaatttatttttttaaatgatgagaatatattaaaaggacacataagcctttttaaacggctcctactggccaaatttgggatgaattgagaattataataaataatgttagtaattgattatagctgattaaatgacatagaaaaaagaatttgttctgatataaataaaccaatgaataagataaatatttgttgaggaacaggatatttacatggtctcaccttgtcacaaaatacttattaattacaacaggaaacagtgaatctacattgaagaggccagtcataccccatttgaatccagtaatcagtatgaacatcattaatgatgagtcaagtcccataggatataatcagaagaatgagacatcacatcaataatgtgtaacctgtatctaattatgagggaacatcaggaaaaccaaaattgatagattgtccacaaaacaactgtcttgtagtcttcaaaaaatgtcaaagtcatgaaagtcaaggaaagactgaagaaatgtctcaaactgaagaaaataaatacaatatgacagctaagtacaatgcttacttgtgatccagagctttttgtcacaaaggccattattggaacaactggtgaaatttgaatagaatctgaaaattagatgatagccctgtggtaaagttaatttcccagagcattcgatgatagcaatgcggtaaagttaatttcccaattttgatatttatatcacagtcatgtataaaaaaatgtcctcatttgtgagaaatacacactagagtacttaagagtagtggagaatcaatttggcaatttacactaaaaaatttgcaggaaaaaacattcctttcactatattggaaactttcctgtaagtttagagttagtgacttcttgacaaacacctgaaatctgagctttaaaactgtaaaatgaaactataagaaaagaggaaaaaagatacgatgctgaattaaacatatgtatcacatacaagtgccactcttggatgaaatgctcttggtacagagcctgctggtaggttaataggaggaacataccgatttccatgccatgttcaaaggtgaatttgatcattctatgcaaattatatctgtactggagacttgtaattagtctaagcataatatgattaggtggatgaaatattttggagtttggttttgttttaaatgtaaatactcatgaaaagtaaaacatactgcactgtgtccctgggaatatttttgttatctttaaaatactcagtattataggcatttattaacacagccttacatttgcccggtttgacctggaggccgaaatgaattgtgacttatgtcccagctggtgttcccaaattatggcaaggactggatgtcatttgttgctgtgaatgacttcttgccagaaacctgagatctaagcatccaaaatcacactccaagggattcctgaaatacactttttttttttttcttttgagacggagtcttgctctgtcaccaggctggagtgcagtggtgcgatctcagctaactgcagcttccacctcgcaggttcaagtgattctcctgccttagcctcccaagtagctgggactacaggcacgtgccaccatgcccagctaatttgtgtatttttagtagcgacagggtttcaccatgttggccaggatggtctcaatctcttgacctcgggatcctcccgcctcagcctcccaaagtgctgggattacaagtgtgagccactgtgcccggccacatatttttttttaatcttctatcatataatcattaggtcgttgagcctttcaaaatcttctgtttgaaaacatccccttcaactctgtcgttgccatgtgaaaagatcaaattgaataatctactacccagtgtctctttatgtatgaaggctttaagccaaacacaggataccattgtcttaatcttcctgctgtataacaaaattacttaaactgggtaattaataaacaatagaagttttttgctcacagttgtggaggttggaaagttcaagtgtctagtgagatctctgtgctgcatagatggtgacttcttgctgtgtccacacatagtggaaagggtaaacaggctcccttgggcctcttttataaggctactaatcatatttatgaaagcagagctttcatgacctaatcacttcccaaggctccaccttttaataccaccacctggggatttaggtttgaacatatgaattttggagagacacagacattcagaccatagcagctatttacccatgcaaataacaaatccagtgatcaagaagctagtcatcaccacagttggtcagttgcaaccactgaataaagacaatgggatatttagctggaaagatgttcagatgacatttcttttctaattttcattgaaatttttcaaagctgctagaagttagacttttttaaaaacactcccattaaaaaccagagaagctatgctcttgtttatattggaatcaaaccaaatttaacccccttttaagattttcttggctgtaagaatttcttggtaatggctgaaagagccctgattatttttttaatttgacttttatttaagttcaggggtacatatgaaggtttgttatataggtaaacttgtgtcatggggtttgttttacagattatttcatcacccaggtattaagcctatacccattaattgttttcccgatcctctccctcctcccaccctccaccctccaataggccccagtgtgtgttgttcccctctatgtgtccatgtgttctcatcatttagctcccacttataagtgacaacatgcagtatttagttttctgttcccgtgttagtttgctagggataatggcctccagttccatccgtgttcctgcagaggacaagattgtattctttttgatggatgcatagcaaataccatttgacacagcaataccattactgggtatatacccaaagaaatgtaaattgttccattataaagatacatgcatgtgtatattcattgcagcactattcacaatagcaaagacatagcatcaacccaaatgtttgatcagtggtagacttgataaataaaatgtggtacatatacaccatggaatactatggagccctggtgattttatccagttgatgatacacttgggattactaaagcatagccatagccagttaggccacttcgtgttattcataaggaataagtcaaactttggactgcctggtaacatttcttcatattaagtcctaccttattctgagtgcaaatccatcatcaggtagtacctgttttctccatggactggacagggtgcatttataagcccatctttgtgtttagactgtactattaagaggaatatagcaaggacacctcttctccatttcacatgaagatggatgtattaagtattaactaggtgtttgcaaaatactttcaaggaaaaaaatgcaataaaagtgctaaatataattattattaaaaaattatgacaatcatttagatgagtaattttaaagctcttcattaaacatgattggatattatgttaattcattaagctctacttcaagtggtagataaataaggtgcattattaatatgtcataaactaaatgaaataatgcctcataggcctattatttttaaagtgccttgcaaatattaacaaatgcttacattcttttgaggacaacttgtacgatttgataggaattgttgcagtaattttgtttctcataatataaaatgcttactacaaaacctagggtctttaaatttttcagtctgtcgttttttttttttttttttttttttttttttttttttttgagacggagtctcgctctgtcgcccaggctggagtgcagtggcgcaatctcggctcactgcaagctccgcctcccgggttcacgccattctcctgcctcagcagtctgtcgttttttaagtaatgtatacttatttaaaaatacagatacatataaatatgaaaataaaattgttgctaatcactaaactacccaaataaagtctttgtgaatattttagaaacttttttgtcagttttctaagcttatatttgtgatctgtgcgcttgtgtatgtctgtatttctttcacaaagtgtcttattgtatataatgtctcatatattccatttctagttaaaatattaaacagaccacccttcccacactatttatgggcttgcaatgctattttttcactaaaaacaagtaaagaaacaagcaagtaaagaaacaaaaaagcagggtttcttagacaaatggctaatcctaggtctggtgtataagatgagcctgaaacattttcataacagatagtaagaaaagtagggcccatcaagagtactcatgatccaacctggagcccaggcactcacagcatcagaagccaactggctgaatgttggacaattcaggcaataacatcaatggattgaaatacatcaaatatgttaaaaatccatgccttcaaaataatacaaaagtaaaaaaataactgtttaccaatgcaggatgcttgtaaatcaacttatgattaaaacaacaaactaataaatagaaggaaagaagaaggttttatcctgttttaaattgtctttatttgtattaaatgtatgtggtaagtgtaattttgttacatggatagatcatgtagtggcaaagtcaaggcttttagggtattcatcatccaaattaatgtacactaagaaacttcttatcatccatcccctcaacctccccctttccaagtccctattgtttattattccacatgtgagcatgttatttaccgcccactaaatatctatgtccacgtgtgcatattttctagctcccacttgtgagaacatgcggtactttctgtctctgagctgtttcacttaagataatggcctacagttccatccatgttgctgcaaaagacatgattttatctatttgcatggcttcatggtattctattatatacatatgccacattttatctcctctatcaacaagtaaccaaatagtagatggagtttttttttttaatagaagtatattacagctggcaagtgagaaagaactgtcagaattagtataccacaattttccaactctaaattaattaatagaccaagacattgattattaacagctgttaacatcaataaaacagagtacaactaaatagcatatacttcctggtgaaataatgcacaccactcatgaactagtattgtttaaaaaatatgaacctagttctggtcaaacttctagatccaactactaatttatagaaaatcagatgatggagaaatatatgagatgataccatggttgaaactagcaaaaataagattgtagggaactctacaaggagaaaaaaaaaaccctggttcttccaatatacatacatactgaagagaaagagataacaagaaggaaacctacagggtaaaagaaacttaaataaaaatatcaaacaattgtgaaatgtgaatcttatttatattttaatttaaacaaaaagctgctgaaagatatcgtcaacatttgtgaaacatttagatatgtgaacactgaatatttgattattttgaaaaacattgttcacctttaggtgaaataatagtgtgtttatgtgtctatgtgtattatacatacacatatatatatatatttaaaaggatatttgtcttatagaaatagatcctgaaaaatgtgtatggataaagtgatatgaatttcctttaaaataattttagggcggaaggtagccacaagataaccatttattatactcttctgcctacctttacatatttttgaaatttaataataaaatattttaaaatatactgacttttctttcttataacaaagttttctttgaagacatgtgatatggtttggctctgtgtccccatccaaatctcatcttgtagctcccataattcccacatgttgccagagggacccagtgaaagataattgaatcatggtcagggccaggggggtggtttcctgtgctgttattgtgatagtgaataagtctaatgagatctgatggttttaaaaaggagagtttccctgcagaagctctctctctctttgcctgccaccatccatttaagatgtgacttgctcctccctgccttccactatgattgtgaggcctccccagccatatggaactgtaagtccattaaacttctttcttttctaaattgcccaggctcgggtatgtatttatcagcagtgtgaaaactgactgataccacatgattgccaaggtttccctaagcatgattaataatatattattgcttattaaatagatcagagggtctaaaacctacaaactgtgaggccttgaaagaaacttgatctagaatttttgtattccaattttattatatttgtctccaaaatttatctgtttttcttacactgattattaaatagtctaatcttttcccattattgtgaaatgaccctgttgcttcattcaagtacactgtgtatgcttcagttctctggcatgtccctgggctaatcctgggttctacttattcgttatttgtctcactgcttttcagctcctccgtttcttttgaatttctctctctctttctctgtctctgacacacacgcgcacacacacacacacacccacacacacacacacacacgagaatttcccaaatgtttgatccttgactaaccatttttatttaaaagcagtaaaaaagcagattggaaaccctggatataggggttaattgagttatagcagcagtgataagtccttttgctttggctggtctgtttctacagcaataaatcttccaatcttctgccttgtctgccagctttctagaagttaacagaagagcttttcttgagggtggggatataggaacctaatgctccttatataaacttcaagacacctgtgttttcagctcaccccactttcagaggtacctgattccttcaatccctgattctttccagcagtcacatgcaggaatgggatgcttcctgttggttttcctctctatctgcataggtgatgataagtttctaaagtgtttgcttcctaaatgagttgtgactataaagaaactttctagcttccaaaccactggtgatatctatgcttattttcttttattcttgagggcagatgccttttctcttctttttttaactgttaaatgaggttttgagctgttagagataagttccaaaaataactaaaatcataactctcaaaatgttaaagattttatttaacttactaatgaggaaactagtgagacattacaaccagttcaaagaagaatccaaggaacagatgcatttataattagcaatatttaaatgaatgtgcaaatagaggcaaaatttgttttttcttcagtaggagagcaaaatcaattaaaactctaccagacaggacagaatgtgtgtgtctatggacggggatgattttgcattgcttttagttattggcaatttacagagttgtaaaataactcccccagaattggaatcatcagatatcacagaaaagtatgctaagacattgcccagttttccactgaaacacatttttcccctacatggctcaaacaggatgaagccatgggttcaactattgaagtttaagtgagtgtatccatacctaattttcctttctttcttttttcttaggtgaactctactagacgatgaagtaatgcctgcatgtttttctgtcaatacaaaataatcaataatttgctttacagttttgagaaaacccattgatgctatgacaaaggttgcctgccttttccattttgctgctgttttcatattttttcttttttcttctaaacatcttaatgagtcagaagtatcatgatagaaaactgttaagctggtattatatgataccagatacccttgaaaatatctcatctatgcagtttcaccaacatttacacaagacttgaaaagcacccaaggtctgtcatagccagagaatattttctcctccagcactttctgtaaggtgtgagatcatttgatttgtgcatgagatcaaaataccagatcaagtgcatcagtgaatttctaattcttggaatgccttgtgacagtcactgtcttggcctaatcagaattgttatttactttagaattgccccacccatatggtcctctcaacagttcctggtgtccacagcccaggctgctgtcagtgttccagttccttgttgcattcataattgctccaaagtcattcttcaatgtgcaaactctttctgcctcaaccattatcagttgaacaagtatatttctatggtttgtgctgtttctgttcctgaatgcaactgcccaaatccatggcaaaataagacctttaggatataagaatatgaactcttcttgaatactactgcttttcatgtcttcttcttacgtcttccactaagtctgcagtaagagacttgcagcccctatggttataggtggggaaaaaacaagagtgttgtattgagacctgccttcaggcctctttcatttttccaaatccctttcttctatgttttctttttttaatttttattttttttcctatcttattgagcaacttctcttctctcagctatagtgcctggagataaaagctgtcatattgcagcttaaatacagtttcaacatatttcagtagcagctatacaatttctatagagtcagggattaacgtcagcagtttggttggaaaaaggcagggagaatattgaaaccatgttcatatgacacttgacatagaattgaggaaataacaattttccatgacaaagaatgagaaggaacaagtatgtattattggggatctgaatgcttgatccttgctacctcctaacctcttggccctacagctgactctattatgccctttgagaaacatcgtaaacaaaagtagtgggggtggggttttacagaggcaggcagatgagggagtaatccacaagtttatgggagtaatgaggtaagatggagatggaacttatcttgaaatatgtgagagcagagtgatcatttgcactcagccatttcttaattcttagaacgcaaaaggatggggagacttctcaaccttcactgtgttccaacttctaggaatttaggactcatgtaaagtacaatatggtcacctgtcacgtgtggtttgcattcctgttctttctgcaagtacatcatagcatgtcccccagtttttcaagtatatgacaaatgtgatttaacttcccattacagtaaattacgatgtcgaagacaaacaaagctagatgttggttaaagacgtccagcagttggttaagacagattttattcatataataactattacaatagggaagagagtctattgtaaactgagctcaactttgccagagcaagagacagaagtgttcttagatgctggggtatgctcaaggaaaggcactgattggtgttaagcatggtgggggagcagagatcagaccatgtgattgggccgtcagggtttgctaactggtgcttatccagaggagaaacaaatttctcctatctttctgtcagaaggtagtaagttggaacaaggtgcccaccaaatttaggcctttatcttcccacagggactgagagagaaagagataactttttaaacttttgcatttcttttttttttttttgctgttacttcacctttatttttttatgttctcttttttaattttattattattatactttaagttttagggtacatgtgcacaatgtgcaggttagttacatatgtatacatgtgccatgctggtgtgctgcacccattaactcttcatttagcattagatatatctcctaatgctatccctccccactcccccgaccccacaacagtccccagagtgtgatgttccccttcctgtgtccatgtgttctcattgttcaattcccacctatgagtgagaatatgcggtgtttggttttttgttcttgcgatagtttactgaggatgatgatttccagtttcatccttgtccctacaaaggacatgaactcatccttttttatggctgcatagtattccatggtgtatatgtgccacattttcttaatccagtctatcattgttggacatttggtttggttccaagtctttgctattgtgaatagagctgcaataaacatacgtgtgcatgtgtctttatagcagcatgatttatagtcctttgggtatatatccagtaatgggatggctgggccaaatggtatttctagttctagatccctgaggaatcaccacactgacttccacaatggttgaactagtttacagtcccaccaacagtgtaaaagtgttcctatttctccacatcctctccagcacctgttgtttcctgaatttttaatgattgccattctaactggtgtgagatggtatctcattgtggttttgatttgcattttttgatggccagtgatggtgagcattttttcatgtgttttttggctgcataattgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtactgcctaggttttcttctagggtttttatggttttaggtctaacgtttaagtctttaatccatcttgaattcatttttgtgtaaggtgtaagaaagggatccagtttcagctttctacatatggctagccagttttcccagcaccatttattaaatagggaatcgtttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgccctccagctttgttcttttggcttaggattaacttggtgttgcgggctcttttttggttctgtatgaactttaaagtgtttttttccaattctgtgaagaaagtcattggtagcttgatggggatggcattgaagctataaattaccttgggcagtatggccattttcacgatattgattcttcctgcccatgagcatggaatgttcttccatttgtttgtatcctcttctatttcattgagcagtggtttgtagttctccttgaagaggtccttcacgtcccttgtaagttggattcctaggtattttattctctttgaagcaattgtgaatgggagttcactcatgatttggctctctgtttgtctgttactggtgtatgagaatgcttgtgatttttgtacattgattttgtaccctgagactttgctgaagttgctgatcagcttaaggagattttgggctgagacaatgcaacaacccttcatgctaaaaactctcaataaattaggtattgatgggacatatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaattaggcaggtgaaggaaataaagggtattcaattaggaaaagaggaagtgaaattgtccctgtttgcagatgacatgattgtagatctagaaaatgtttgcatttcaaagagacacccctctacctcctgcctccccttcacagtccttgagaagacagtttggggtggcagaatatttacatataaacaggcagagaaaggatttataattgcaaactttctaaagtatctgctctaagaggagctttaggggcctataagcctatcacaagcttttgactggaacaaacagtaaattctcctggcagtattgtgctttctggtgcaggctttttttttttttttttttttttttttctgagacagagtcttgctctgtggcccaggctggagtgcagtggcactatctcagctcactgtaacctctgcctcccaggtttaagcgtccctagtaactgggattacaggcacacaccaccacgcccggctaatttttgtatttttaatagagacagagtttcaccatgttggccagactggtcttgaactcctgaccttaggtgatctgcccacttcagcctcccaaagtgctgggattataggcatgagccactgcgcctggctggtgcaggcattttaatgagggtaggatgatctttgggacacagccttaaactgctagaagctatgctaaagttaagtctcttagtggtggaatttgggtggactgattattgctcagaattttttgtagttctcagtggaagttctttttttaaataacccactagtgaccttattgttgtaatggtggacattggcagtgaaagactatctttgtaccagattacaaccctgtaagcttctcaaacactcagaaaaatccaagaattctcaagaaattgaccctgttcagtcaatcaagccagacaagcatggggccaggtggtactgtgagatttcttggagtccagtgaaaacctaaacaaccaaacaaacaaaagtaatgtgacctagttaccaaaatattacgcttcttctttgtcatgatatgtatatgtatgtgtatgtctccctttacaggccatgtagtatatttcccacccttaatattaatattttgtaattgttacagcaaccttaagaattttcctaggctgctattcattaaggaggatactggccctgggctatgcttgcagcttccagctcctcccagcgagctattaattctctaaaaatgttttggtacttaatatgctgcctcctaatttatagcatctcactaagaaggaaacaaaaacaaaaaaaaacacctaatgttgtttgacctctgctatatcagcatgagggacacatctgtgtctcaacagctaataaaaatagagtcacaagggtgatgggcaaattttggtgagtgatttttgttgttgattaccacagacactagaactaaaatttcagtaggttgctactgattgcatgtcatggaatgctgggccatgcatccacatcagtttaagtaacagtggttaactggttaagtcattttccagacacagaaaaagtttgaggtacatattttttcttggtaatccaaaagaacttccacatcatcacgtaattgtttatttgctatttttacagacatttaaaaaatggaaaaacagaaagattcagtagtcatttagcttttataaaagaagcagatgccagggccccacctacagagatctgacagagttggtctgtccacacagagcctagatttttacatttcatcaagtgattttgatatatttcaagcccacacattgggaaaaactgctttcagacacttaacacatttaaacagagaagctttagctcaagtttgcatacaaaaatctataagtgatggaagcatataattgggctgctggttgagaaaggcagaaagcaacaggaggccattgagataaagaggaaaaatggtaagaaaattaggccaactatttgtagtgcactcatttcattttcttgtttagtttacattggttagaagaagatgacatggactaagtgtaaggtgaggtagtgggagtcgagaacaggaagaccactttagggtggggaggtctagaataagaagctgagcttagaatgtgatgtctgtgtgaaaagaactttagagatctccagattaaaaagagatctccatatttcctaataaggggaaaagaaaagatatgtccaataaaagagaaataatggggacttctaacaaatattgatgaagtgaaggaatgagacttccaagactgggtcataaaggacaccacagctgttctttgctctctcaggtcattctgtctggggaaagccatctgccatgtcataaggacactcaagctgtcctgtggagaagcctacatgacaaggaactgaggactccttggcaatagccagtgacgagtttaggcctttagccagcagtcgtgagtgtgccattgtggaagcagagcctttggcccataattttcaaccaaaggtgattttatacccccatggacttgtcaatgtctagagacattttggttgtcacaactgggaggtgggggtaatactagcgtgtaatggttggaggccatggatgctggcctcatagatatatgaggtatatattcatccccaaatatcagtagttccaaggtaaagaaacctgctcagtcccagtcaagccttcagatgactgcatcccagttgacatttggactgcaacattgaggcaggatatttccctgacctcttcacgggactcacagagggagtgcctcatttactcaacccacagttcttgactccttgtgggaggaagcacacaagtgagtgaggcaggaactggagtgcagaggtgctagaactagccagctgctttggcaccagcaggggtgaacttcattcacttggacctgctgtgatctgcccctggtgggaggaagcatgcaggtgagttggtgcaggagccaggatgagcgcttttagggtgccagcaggagtgaactccattgtgggccctgcagcagcacctggagggggtgcctgcaacccatgaagccgcagaggcagctgccttccaccggtgagggcaaagggtcagtgtgacagcctttttgtatccacactcttggctcctgagcccttatctagcatctaggagaatggaggtcacacgaatgaattgaaggatggtaaatgagggggattttattgccaatgaaagtggctctcagcaggaaggggagctgaaaaggggacagacgagatgggaagataatcttcccctgaagactggccatctccagatggatttatctcagaagttaggccctcaaggtttccctctgaagtcaagctgcttctctcctctccccaattgtagcctccaacatctagctgcttctcttctctctgctggctgagcctggggtttttataggcagaggatgtcaggtagggcaggccatgggtggttttggaaaaggcaacattcaagcaggaaaacagggatgtcagttctcactttgagctagtctcaggtttttcggcttgagggtggggctttgacagggacccacccctgtctgcctagaatttctcttcctcctgtccccatcaatgtcatgagagattttgagccacagccactcagttcatctgctccaggatttctgacctttcaaatgtgtgtgagataataaatgtgttgttttaagctgctgagttttgggttatttatgcagcaataaataactaatacagcccccaaaatgtttctctagggttggagtagatattttaagtaaccaaatcaggctggtatttggagggcataagagggacagacagaacatgaataaatatttctgctaaatagcatgttgggcagtaaagtatattttattatcatagttcatgagacttaccaaagctcaattagtgatgattataacaagtggcttgttaaagctgaaacttacatgtttcatacctcttggcagaaagacactggtaactgtcaagatttccaggaataattaagagtgctgaatgaggcagcaaggccttatggaatcagtaagtaaagaaaaacagaagttgcatatttacaaactgaacagtgaagtgagtaggtgataaatagagaagctaccaggatagaagcaaggtatgttagagatgatgctgtcatctttgtaaactttagtggagggctcaaagaagagaagttgaggctgatgttctgcaaatgtgactgaatgcaaactccctggagagcctgtggaaatgcagattgaggggctgcagattctgcatttgactaacaagtcccaagagaaaatgaaagaacttgattctgtagagaggacatttcttcttgtaaggcctcagagatgaaagggaattatattgataagacacacatatttggaagatgagaaaagggatccattctcatacaactagttcaggtttttttttaaaaaaaaaaacaaaggtggtgggggtggatcaccataatcctgccaagagtgaaagtaataggaacagagggggaaagcagcagaggaagggcaatggtttggaatagctgcaaggaataaataaagtggcgatgagctgtgccataagagcgagggcctcatcaagttgggataaataggatttactgagctacagtacacaatcacaggaacaagaggactagaagcttcagcttttagaaatgccacacacatacacttctaggtggcaggggggtgcaaagccagagattacgtactactgcgggtgtcttttctttcaacgagactctgtggcagccaaaatttgtagctgaaaagtaagctgcacagagcagttagacaagagcactacattatttgtgcagttttttgggggcttgtgaaatggagctagaaataccattttttttcctggggttgcatgggatgcgaccgtaagtgaatacatcatggtgataggctggacatgacccctttccctcttaagtgaaggttgaaggagctatgttgaatgagaggatttaaaacacattttactattctcaagaattttatctctcattgcaggctttttggcaggtagttaagattccatgcaaatcattttaaaataaagagggttgtgtgctcactgactgtgtagtgttcagtcttctgaatatatcttggtgtcattttccaataaaatgagcaggaatataaaccttgggttaaaaataattcagaaatagcagttattctatccctacagcatgcaatgtgtaatctttgaaaacaaaattactcccagacacacagaaatgcttaatgtataaagcaaaaagctattattatatagtcatcttagatttcttctaaatgtgtgcacagcacaaataattaataagtgaatgaacattgttaaacatgcctgttcgaaagtctcatcattagttatttcattatatattaattgttttcctgtattgtataacttttttctgttgatatcaaggtaaataaaatatgattctttttccaaggatttcagaatctattaaagagacagctagggaaatttatacagcaatgtaataaatgatatgttaaagataaacattataggaaataattcttctccgtggaaagaaaccttccttggtggctgaatcttcaggtaacatagaagtttgccttttgatatatttttaaagtgttatacgtatctcccaccaaaaatatattattggtacaatttctgaagttttaaaaattataaacaattttatattgactctgaaagcaaattattgtctaaatcagtagtacacagtttattttactgagaaagttttatttgccttaactattatataaaatatattaaataaaatgggtttttcatttaaaatgatatactgtcttatttcttatatatcagaataaattccaaatggatcaaggattttcgtgttagaaatagtacagtgaaagtacacgaagacaaaataaaatgatttgtatactttcttaatgaaaaataaaggataaaattgtcacatttaaaaatattctacagtaaaaaatggcattaaaaaacaaaagaaaaaatgacaacctgtagtaaacatctttgcaacaaataagcattaattttctaaattcatagaaatatacttaaaactgaaaatcaaaggatcaataaaaacaataggatatttttaagtacatgaaacagattatgcaaacacacatgaaaaatgcacacttctttttttcgggtgtggaacattaacataattagacatgaattttccttcatccaattgacagttgttcacgggattggaagaatgtggagatacagataccctcctctactctgggaaagggagtaagatatccttaagacaaatttagtaaaaactgcaagaaattaatggagcaattttacttctacatatctatttatcctacatatctatttacatgtgttgatagcagtaatgctgattacagtattgtttgaaagaaaatctcaaaaacaatctaaaagctcatcactaagaactagatcaattatcatgtgtccataaaacagaatattatgtgactattagcaagcataatataaatctatatatactgctttggaattaattatatcaaagagatgtagatataggactaaacacacacaaacaagatgtcaggacatctttgtaaaattttctcattcattttaataaacacacatatgaccttgtattagtttgcactctgaaattactgatatttgacatttttaacctaaagaaaagggactctcatagagttccaactaatatctaaaagtagtttcttgaaggatagtcaggaaactgttaaaactgtttgcctctggggagagcatctaatgcagaaggcaggtgcaattttaagcttttaaacaagttcatgtattacttttcagctgaaaagggatttttttaattacacaagttaaaataaataactgcattggcaacagacaaaaaaattgagcaatatattgaaaaatctttacataatccctatcacttatattacaagaactttggtgatctcttacttttctttctttctttcttttttcttttttttttttttttggtagtaacctccacatgctggaatgcctcagagtacattttaatatgattgcatcaaataaataccaaatttgaaaatagaaaagcattaaaccaattacataggtgtccactttaggttttcttgaatgtcctgagaatggaaatcatatcaaacaaattgtagtgaaactttatagggtcattttctttacatatcctttccttttcctaaagaaccactcctgtttttccccttcccaaatctttagttctctagccctcatttcccattctcttttgctgcaatccacctgtctgaaccatttgcccaggtctaagcctctgtctttgcatctcagccctgcctggtacctgtccagcaagggactggaagctgctggtaagaaaggttgcttctccatcagcagtcatggaggagaaggcggatctaaaacattaagacatgccccctcttatctgtcacatcatgcctcatatatctattttataacaaccccctcaaaattggaaaataaaagatctctttaaaacttaagccaggtcatgatgtagggtctcaagatctgccctgcccccaccttgccaacctatgtggctctcttctctctcgtctctggctctcctcccctcatcacgctggcctccaagctctcattccaacatgccaggcaggcttccccacacacccgtatatctcaattcctacttcctcacctctttcaggttttaattcagttaccaccttcttggtaaaactaaccaagaccaaccttagaaaagcctttgatgcctaccttgaaatcctcatactttgctctttcactctctctggctctttattttttacatagcaccgatcacattctatataatatagcatttatttattttatgtatattgtttatcacctctctctctgttctgtctaggtcagctccatcaggtaaggggttttgttttgttttccattttgatgtcaagaatatatatcaatgtttgagatacagggagtgctagtcaagtaccttactttgagttgctgattttctttttcttctctcctgtttttacttattttttcttttttagatgtcaatattattttcaagtaattatgaatcagtttgtactttaatctgagatatcttgaagggataagtttattggtagcccatggtgatggctttgtgcaaattagaaaacaatgtcatttttgtaaagacaaagctgcaagttgtgtaacttgcagtgctaatcatgggctagtggttagactatattcaccctggggaaatacaggctaacacttgtgcaagaaaaaaggaaaaaaaaaactgtcacaactgtacattacaaatgaaggatgtaaaattactacattctataggcattgaaaagacaacaggaactattatgaaaaacgttatgtcaaagaatttgacaactttgatgaaatggacaaagaccttaaagatacaaactactagagttcgttcatgaaaaaatagataagataaataccctgatatttagaaaagaaattgaatatggtgttaagtagcttacacatacacagaaaaaaaaaaaaatccctctaagctcacatggttcacttttgaagtctgccaaacatttaaaagaaatgaaacaaaagaaaatctgattctacacaaactcttccaggatatttaaagaaggaaatattatctaactaattctaaggtcaagcattaccttgattccaaaaccagacaaagactttacaagaaaataaaaacataaaccaatattttccatgaacataaattcaaaagtccttaattatttagaaaattaaatccagccacactttatatagaaaagtatattgcatcataatcaaacaagtatttatcttagagacacaaaagtaaattaacatttgaaaattaatcattgtaattcagtatatgtactaactataataaaacatataaccatctcaaatgagaaaacttatttaacagaatccaacattcattcctgatagaaaaacaaaaaactcttgggaatgtaggaatggcagacaactttctcagtaaatggcatttatgaaaaatctacattaaatatactttttagttaaaattagaagtttgttccttaagatcaggattcagacaatatgttcatatttaccacttctattcagaattgtgaatctcaaaattattatgcaaagtaaaaaagccagaaaaaaaaaagagtatgtactaattgattccatttagagaaaacactaaaaaatacaaactaatctataatagaaaaccgattagtggttgccagggaaaggggactgtggaagtgggggcgggagagattaaataggaatagttagaaactttttgggtgaggcatactttcattattgtgattgaggttcatgatttcatggatgtatactcacattaaaatttattattttttgcattttaaatatgtgcagtttattttatgaattaaacctagataaaactgttaagggatacttttttcaatcatttttcacatgggaagtatatgttagctatgccattttgaaggggaagagaataaataggctttacagtttttatttttaaataaagctgggaaatgctaaatgggaatgaggaggctataattgttgactctttgacaatggaatttcaaacattaatggcttgttctagatagtacaaattcactgatttcattattctgagctcaagtaatctttgaaatctgggagtggatttattaccggagacataaggaaagaaatataataaacattgcaaatggaacaatcgtgaatcaaggttatattttagaattatcccaaacaatggcaagtgccttgtctagatattttcttccatcattaaaatatttcacagaaaatcatcaaaagcctggagaaatacttgtctggactttctacatgatagtcccggatgcaattatagtagtatagctgtctctgcaatttttttttaaacttttacacacattaaaatattctaggctgggcatggtggctcacgcctgtaattccagcactttgggaggatatttgataatttgaggtcaggagttcgaggccacatggtgaaaccccatctctattaaaaatacaaaaaattagctgggcatagtggggtggttgcctgtagtcctagctactcaggaggctgaggcaggagaataacttgaacatgggggtgaaggttgcagagagccaagatcgtgccactgcacttcagcctgggcaacagagcgagcgagcgagactccgtctccagcaaaacaaagcaaaacagaaaaccaaagaaaaatattctaaagaaaaaaaaaatcagttgttgttttaataggttcagaggtaagtttgccatatcttatttaccatgaatgactctagtaatggcaatgccatcaatgcctctcatcttccaatggttgccttttcttctgttattactggactgttgggactggtagcactggtcatataagatgcccacagttgctaaaggaggacactgttagaaataaagtgacggccgggtgcaatggctcatgtatgtaatcccaacactttgggaggttgaggcgggcaaatcgcctgaggtcaggagttcaagaccagcctggccaacatggtgaaatcccatctctactaaaaatacaaaaattatctgggcatggtggtggttgcctgtaatcccagctactccagaggctgaggcaagtgaatcacttgaacctgggaggcggaggttgcagtgagctgagaccgggacattgcactctagtgtgggcgacaagagcaaaactccctctcaaaaaaaaaaaaaaaaaaaaaaaaaaaaaaaaaaaaaaactggaaagaaaagaaataaagtgactactgcaatagataaaataaattgcccagctgcctccaggtttgctattttttcattatcagtgttttcttgacagtgttaaaacatttggccccctaaattcacagtttattggaacacttgatgaaagctgaatctctgtagtcatgctgttagtgactcactcttcctttgaaatgtctaatgcatagatttggtgaaatgctgttttcttaggaaagtttggtggacattaaaattgcttttgcaagtgaaattaaagacattaatgtaaagtggcagtgctaatagccagataattgcagtgttagaataaatttcagagtaattttgactaccaaccatctcttcacagctaaacttcagataaaaataaattttacatggaaccgtactgagatttctgctcaggatctttacccaattatctcttgcgttcctgttatttttttctaactgtttgagtttcatgtagagtgctctccattctttttctgtcaatttattaataatatattttgcttacggttcacttcttatcagtttaattttattttacttggacagagaatggtctgtagttttcttagtaagaaaactgaccaggctaagctatcgttgtttttttatgtcctccctcctttattttcaatgtcctccctcttccatttttagaacatatcctattttttctaagttatttatgtaagtcagatggatttactgttaatatgttaatctgtatatagtgaaaattaagaacctatttttcctaaatcatgcaggcatacattaattcctttgacaaatatttactgagcatttcctgtataccagatcatatgctaattgctgaaggttcttacttaaatatttactattccctcgtctgacaattactcactgggctcttactatatcctaggcattgtttcaggagctaggatacagtagttacagcaaaccaacacacaaactaactcaagtcctctctcatggagactgaattctattgaggaaaacagccttctccccagtccctgaatatacacccttactcacacatatatattttaatataatgtacacatataaatatataaacagcatattaaatatatagaatgtctattatatattgtaacaagtatatataagtaatattacatatgtgatattaaatacatacacaaatatgtatatatatatacagagaggcatatgttttaagtaattttattttacttacctccctattactgtgccatttcatagggctactaaaattattatgtgcctttctattattggtactctggtatatttgtgtgtgtgtgtgtgtttgtgtgtatgcgtgtgtgcgtgtgcacatgcacgcctgtgtgctgttgggcaggtgatcaatgatgataagtctgtagccagagctaagaccatgtgtgtggcgtatttatgtattcatgattataaaagtcccagtggtctgctgaggtggtctaggttggtctgctgaggttgggttgctatccaacacaaaacgcaagcactaatcaaatgtttgtttggataaagagcaagaacagatgctccaaatgaatacattaaacagagacccttgggtcattaaagcttcatgcctttgatctaacaaactcagatctacagacgcctcatcagtggtgaagctgtttcccatctgctgggggtggggacctagttctcatggagggttttgaggacaagcatctcttcctcccaatgccctgattataacaagccaggaaagagagcccaaagccaaatgcccctgccattgttggcgatattgatgtcacgtttgctgtacgtgaatagttcttcttctaaagtaatagattcatattgtttgctgtcctggctgtctcttttcttttctttcatatcttttgttgtgtttttaaagtgacttttatatatgaatacaaagcaactcacgaagtagggtgtgggttgggggcaagaagtgccctgcaggctttggactgtttgtccaccaggtataatcacactctgctttagaaaacttttaaagtcatcagcaaggctcaaacagactcttttaaaaaaaaaaaaatcatgaattctcatgagccaattcacagattgtatttataattaatagaaggtctggggtatcctatcctctaaaagatgcttagacacaaagagcagtccttgaaattatcaaggtatttgtctcaaaaccacacaggaaacaacttcagccctcagtaccagagacagacagtcaatcatagttcaaatagccacatggacaattcagaagagccaggctgaagctacagagcaagggaatggatatgtgccaagtgccagtgcccagctactgcactagcattttcacatgaactcccaggtttaaggccccctccacctctgggagggagcataacatttagatcctcttgacttgaccaaaaaagcttgggcagggtagaagtacatctctccctcaaataattagaacctgaggtaagagtcaacagcaggtataaaggctccataaaacctttgaggccacatggttcttttaactttataccttgtcctccctagcatgaggcttccatcctcaaggttacaagacagctactagagccccagccgatgtaactgtattccaggtaggaagaagaaaaagacaacatggggtaaaaagagcctttcttgaagcccatttcatgacttctatctgaaatctcttagatgattagatgtactcattgccattataaataaaaaaccatgttctcttaccaagaaaggagaataatatcggataggtaactagcagtctctgagcaaaaaggtataattattcccattgaaaactgagtctcaaagagataaatgaactgaaccaaggtcctcacagagtcagtcaatggcaactgacagttttcccagaggaacatctgttatggcatggaccacaggagtcacagcttgagtctaagcaggggctgaggttgtctgaattcatctgccattgaggtttcctgggatttaattgcataagtcaattagaattctaatttttgtatgagacaaacaaaagcaccagggtgtgcagagaatgtagatctgaaaaggactgtgaagggatgtgagggagagctataacctatctgggtatctttttttaacaatagcctcataagcacatatccaaacctaaggagttagcaaaggaggaaggagaattctaggatcaccaagccttagcatcaatcaacagggagtaaaaaagatggtattcactgacctttttgaaaacacagtgtgccctgagctcagcgagaacttcaataatgtcaatagctcatcaagtgtttgcagctttggggtgatgtgttcttgtcaagggaggacatgagcactgctgcaaacactagaaaatgatattagcacaaacactagaaatatcaggtttgtaagaagatacttgaggttacagccaaccttccacttgcttcaggttggccatcaataatgggtgcatttatagtaagccttcaattcccaaattatatctggagtttgaaaaaccaatggcaagaggcattgcctgattcaggaaacacatccaagccaactgacctgttaggtcactgaccacagttgaatgtaacgtttatgggaagcttggatcaacgaactgggcagccttattatgctgacccatggtatgtctactctttggggaggcttttcatgtggtgggagtaagaaagccccaggcttacagtttgatatttaatgtgttcaaatctgcttttctcttacacctttacccccatgcttctaaaaggaatttgtatgtccataatatatatcattacactgtggtgacaattgtactggggctgattcaaacttggagctaataaacaataaatagtttaaataatactgccatacaatttctgtcattactctctgcaccacctcctctcctccatgagtttcatcctgtccatcagttctctttagtactagctgattaaaaagtagatatcctgccaataaatctagtaagctgtgaaacatttgagacacacacttccgagactgttttcatcagtggtagattagtaacaatttgctaatgaagattttcttttaattattggggaaaaggcatttcttaattaataggaagattggtttcatccagattaattattgccgggaatgtgtcccaagcccactaggcacaagctatttaaagttatcatattagcaacaaagttaagcagcttggggtttagtcttaataatgcggaccatggtaattaagttgaggcttatggatggagggtcttcaggggggtccatgaactcataaaatttgatggaatatgtttcataactttctcagcttctcaatgaggcacatgatggccgagtatgagcaatagtctctggggtcgctgtcatccgtgttcccacagcatgcactcccaccgtccagctttcactccatgatggtccagtaactagtcattagtgaggccagaaatcagtgacaaaggaatcacagcctcgagttgaagagaccacaaagatcaccacaaccaggtctctcattctaatttttgtcactgaatgctgactaacaaagtgttagtatctcattttcttttcatcaatactctacagctcatgatccatattctccgccttctcacgatgatgtccattatttccctttttcagttttccatcatgatacatggaattcagctccatatttgatgaatatccttctattttcattcccagccattgttctgattgtttgctccatcccgttcctgaaacctgattgcaccttgttgaccttcttcagagaaggctgatttctatgtgccccttctgttcctcatgttctgaaagtaggtttgatatcctgctgattactcaagcccttcctatagcacgtacttcttcagttcttgaacaatagtgttattctttgagatacaacatatcacaattcatcctagcctgcttattatcatcaacaattttttgtagacaccatcttttattaaaatgttggtattatcccagttctacccatgaccttgacggtctcatctccagtaattttttcttccacttcatcatatccacccactttcatgatcacactttggatctaatcatcaactctgtactaattccattgctgtgctctcagaaaactttgtctcctcatgactggtttattcagtaatacctaccttgatcttttattaacctcataagcatctttagtcctttgatccctctttttttaataccataccagcaaccttaacattttcctttctttctttatcctgcttagattccttggcccatcaattcaggaacttcagtgcacctccacataacagagtgcgaagaacatttctgagtgcttatttcacatgaaatctcaacaatattttacccattgaacccaccctctctgtggtgacttttcttttccctgggcatccactctactagctttgctccaattatctggctactacttcattttttttctttcagacagtctcactctgttgcacaggatgagtacagtggcgcgatctcggctcactgcaacctacacctcccaggttcaagcgattctcctgcctcagccttcagagtagctgaggttacaggcatgtgccaccatgcccagctaatttttgtatttttagtagagacagggtttcgccaggctggtcaggctggtctcgatctcccgacctcaggtgatccacccgcctttgcctcccaatggctactacttctttacagatccatttgcaagctgagccttttcttctcagccatcagttgctggagagcctctgcttatgttctcaggcccccttcataaattactctgtattctctcccttggtgctattctttatcatctatgtgagcaagtcttcaaacctttattatagctcaaaattctccagagagatatagatgttcataactccttcccttgactgtcttaatggaaaattaaattcaacttgtccacaattaaaatgtcaattatcccatttaacctgattattttccaggtatgcttctcagagtgagaccctattcccatcaggttccatagtctgaaatcctcagccttccctctgacactactctttcccttatttgcatctaaaaaaaattgattttctgtctctcagatccatccatttcactttcatctccatttccaccaccatagcccaagttaccatttataattttctggacgaatgttgaataatttccattttgacattgccgtatggttaatcccttgaatcctcttcccaccatggctagagttctttacaaactgcagatctgacttctatcccaattctgaccctttatcctccactgttaaatccaatcatggcttcctgttgctcagtttgcttttccagaggtaatctgaaaatagaacactttattcttcgtattccagccatgtgtttattcatttttatacttggatatggtaataaatatttgtgagatgactttaataaatgcatgatacattatatatacagagtgtagtagggtacttgcacatcgtctagaaactttaatgcaacagtgattctacacaaacctcatttccatctttgggagtttgaacagcacctgatttaagttgaaagaagcagagttctgtgtttctgactggggtccacagcagagcgcccctgcctctacgtccattctcctcaccttgggttccaacactgacacaaaaatgagggactatagtcctctgaactcaggagtggtcaaaacataacctaaagcccaaaggtagctggaagagttgtgatatgattctcataaccaactcttctctaggtggcacacagagatttttgtcggtttactgaaacaggcaccaccctgaggcagtaccatggttctgagtgtaaacactgcccagatgtggctctttcatgcctcgggtgtgaggcagatgtgaagaatgatgtctccagcaccaggagcagggcttagcgatctgatgttaatgtgtttttttccagctgtgatttggatatctcaacagtggaataatttgcccaaagtacccgttgactctaagtagtctttagtgcggtgctcaaaaggctttacacagagatactgcctggaaggaaagctaatttttttttaactcacaggcctgagataatgacgaaaggagaggagaataaaattaaagagaggaagacttgagaggaggtgaaagtataccatctaccctggggcacccccagccaagtgatattaagtcttactccttgtcaagaatgtcagaatcctcttgtgtgtgtgctcccaacagttacttggaccttgggaagccagaattcaggaacatgagcagacttcatgattctgctagtaactctttgttcaccccaagaacagctctcaagagcccttctagcagtaacatctcagataacttcatgtttatacatatgtatgcatacacccacaggcatgaggaaaattttagatgcaaagctgacaacattccaaaatttttgtagaaatttgctaagcaatagaaatatatcagtgaaaataatacaggagctaaatttatacgtcagtttcttgctcaccaacgcagtttttcaatatcaaggaagtgaaaaattaaaccagcttcctccctccctcccttattttctttcttcctttctcttttcttctcctcttccctcttcttctctgcccgcaccctctcctttttaacttttatttgcctgtttgcctttacttttattttcaaagccctttgaggcagagatgaacttctggcagaatgtctaaaattagctaggttctctggaaatgcagaactatttatgatacagttggctttctcagtactacagagagccaataataaccactcttaaatgatcctgaatgtggctagtatgcttcattgttgggaaatctgattttattaccctcttagattctatatttttaatgtattttgtaaccaatgagatttccacaagaaataaggatttggccttccccttgatgagtcaagcctgcatattcccctatgagtcatgagtctgcatattattagattggagttgttcctgctagatacaggccaaatttaccccaatttgaaaatatcaaacactgtaatcttaatataatattttgatgtgtctattattaggaatggccagagcaaacagttgagatctgtaagttcatatttaggaccaagtttccatgctctgtgtagagactgagaagcgttctgagcctccatcagcagctgttgcgtccactgaataattcattcaggaaacaaggactgagtacctttcatgtgccagattatctcgaaggctctggtgaccttaggatgaacaaaaaattatgctttcacaagtagaaggaaacgagtatgaatttgggaattgtctgcctttacattatagattgcctctattttctggtgggagtttagcctcatgatattggtgagagccacagatcctgaagggcatgaatttaaggctcagctatgctacttcccatctgggaactgctgttaaagtcggtaaatgctcaagaaatcaatcagaggcccttctcctcgttcttctttattttccatcatcaccaccatcgtcacctataatcaccatgatgatattagatattggtgcaagtagaatcagagatgtgtattgtttgatccaaatattgtatgttgcaaattgaaagtctgccatcctataaatatgaaggagcagttagggagtttcagtaataagcaaaaatgaaggtaagtaacttggactagtcagccatttatgatggtaataataataataataataataataataataataataatcagaaataacaaagtaactgtgaagttgagatatttgaagactagtcccagtactaaggtgctttggggcaatgcgcagttttctaaaagtaatcattttcttgggttggacacagaataaatttttagtactttattttcctggttcttcagttcaattttgctacccaaacttactaccaattatggtttctttacttcaaaattccaaagctccccagcaatttgcagggtgagattttgtgtgactgctggaaggcacattccaaaacataaagaaactttgccattggcagaaatggcctttctgggacacattcatcaaaaatgtgaaatgagaatttaaaaagccgcaacatgccgggcgcggtggctctcgcctgtaatcccagcactttgggaggccgaggcgggtggatcacgaggtcaggagatcgagagcatcctggctaacacggtgagaccccgtctctactaaaaatacaaaaaataagccgggcgtggtggtgggcgcctgtagtcccagctgctcaggaggctgaggcaggagaatggcgtgaacccgggaggcggagcttgcagtgagccgagatcgcaccactgcactccagcctgggcgacagagagagactctgtctcaaaaaaaaaaaaagaaaacaaaaaagctgcaacatgtggcatcctccaccactcccctttggagcccaagtgacaagaagagagagtactttactgagaatcattttgtttagaccactgtaagacttaaaaaaaattaataactttatttcttaagtcggtcaagatgaccttgattctggtgattagaaaaccctgtgtctcctgaactccttgccttctttcaccctactctccctccctctgtcatttcttcccactcttatttcccactactcatcatgtctccctctctttgtctctttgccttctttcacatctctgttttttttctatctctccctcacaaatcaatattctcctcagtagtcaccccataaatgaagcacaaacacacatcaacaaaaatgtgcacaaatacatgcggcataaacacacacaaactcatttttgtccacattgcacagtaaattatcagagacttgataatacttgttaatgagctcagtcacgcttattattcagtcctatatcatttttctacacccaaatgaacaagtatggttgtagagttttggagagagagtacctgctctttatcaaacctgtaggaagattctctcatgaccaccatgttatttcaggcagtatcttccttccctagcttacctgtctagcaatagatttaaaggacatatgtaaagagaaacttaaggtcataatcttcaggactcacaaaacaggtatcttctcctgtggatcctaaagcttatacattttcttggctctcttcaagaaaaaaaacaaaacaaaacaaaacaaaaacacaaatttacaagcagagagaattcaccaaagttagcagagactgggagatccaggtcctccttttgtgttctttttaggcaatgcattgaaacatgtttgcatagagagtttcctgattgcaacctggcatctcctctctacctgcaattctctgcatttcccatcaattctcatcctccttagagggttgaacaagagatgaaccctgaagcctgggctccattctctgcacagtaagtccacctctgggaggcaataagcccaagttccaaccttcccccttaggtggaaggcagctgtgacaatgagcttgggaccctagcctgcatccacaatatgttgccagtccatgcacatagctcctcctcccacaccccaaggtcctcaccagtgcctggaaaacccatcatgcttcagcgtactatggccttaaaacagctgcaacactgtgactcctttgtctctttcttagttatgtcactctcagtaagctccagttgttacaggagaatgaatctctggctgggaccttaccttgggtggtgttgttctcattggttgaaatatgttaatgtgatcgaaaagcccagagtatctggtctgtttttagctaaatatggattaaggtcatttcagaaactggctaaagcaagcatctttgactccccgttaaggagcagattgccttgaaagtctttgatctagcctggatttgtcatttttgccactctgaagatatatggagcagtggattagtgactgtcattctttggaagcactgctgaacagggtgcagagcttggacttcaggttggacagctctggtttctgagttccaatcttgaccctgtcattggctctgtgacctcacacatgtggctcaacttctctcctctgtatttcatcctttgtaaaatgaggtaaacgatacttcataggtggtaaatacctgattacagagagatgaaccaactcagttgaaaccacacacctattcaaaagtagaaccagaattagggatgctccaatgtcacatgtgtgattcctctacaagaacaagtgggagataattaggcagcagtcaaaaataatgtgaagctatgctaacatctatttatcacaggcaaagttttgattaattaaatgagtgagaactttgttctttggcttcccctactctcttcactgtctatatctccctatccatcctatatttaaatggttatgtttcccaagtttcgggcctgaactcttctgttttctttctaggttttatccttactgatctctaatatcagcaaaatttcagttgtcttctctggcgtgtaagttgtaaatttgcttttttaagaaagcccaaatcatgaagatgattttcctgagacagtgaagactaagctgagccagaaagaagcaggcctcaagcaggcgagagtactaggaaagaaatgttttaggcagtggggacagaaagtgcaaagggtgcctggtgagaaggagctgaggccatgaggagaatggaggacaggccatgtggccagagcacaggagaggggtggcaccagaggagactggagaggaggaagggggcatctttttatattgattttaaggaaaatggggtattgatttgtttgaaaatgcacctgggtgatagacatgatcagatttatggtaaaacaaacaaaagaaatatgtgaccccatggcaaacagaagatttcaggggctaatgtcaatgtggagagtagtaatgagctttctgccttcatttacgactaattacagcagcttgggtgatcatggtggtggggaggagatgtaagggggaatgctgcagcaggtcctcaaatattgtcattttgttagactattgacaagggaaaaacaaaacaaatcaaaacaaaacaaatcaaaacaaaacaattccaggcctgggcccctgcctgtgtggagtttgcatgttcccctcaaatctgcatggtttttttgttcgttggtttgtttgtttttgtgatggagtcttactctgtctcctgggctggagtgcagtggcacgatctcggcttactgcaactttcgcctcccaggttcaagcaatcctcctgcctcagcctccctagcagctgggattacaggcatgcaccaccacacccggctaattttttgtgttttcagtagagatggggttttaccatgttggccaggctggcctcagactcctgacctcagatgacccacctgcctcagcctcccaaagtgttgggattacaggcgtgagccaccgtgcccagcccttcatgggttttctcaggtattgctgtttcctcccacatcccaaagatctatgcatgaggtcaattgctgcagtgtgagtgagtgtgggtgcatatgaatgagtgcgccctgagatgggatggctggcatcttgtccagggctggccccgccttgcaccctgagctgctgggacaggctttagcctcccttgactctgagcttgaataattgggtaaataattatcttactttttaaattcatctttcttaaatgtatatatagctcacatttgtttcaatggtaaatagtagaggtctttatttaaaattgtgtgatatttttgtgaccagaaataggcagtaggaacttaactcttatttatatcaattagcctatagtaaaattgttttcattatactgtattttgcttaaagtggcaatttctaagaacctattgatgacattaagtaaagacttactgtatttggaattaaggtgacatagattgctgacagatcagatgtgggaatgaaggaaagtgagaggtcaggataactccttgattctggcttgagtgcagaatgagtggtatgaggtctaccaggagagagcacactggagacaatccaaagtttgggggttgggggatggaagaatagcctcagctataaatcttcactgggctttcagacaggttgagtttgagatgactttgcagtcgggatccatgtgaagataccaactagaaagttaggtctggagctcaaaggagaggcctatgctaaaaatataaatatgtggagtatctttaagtaagtgaccatttaagccagtgtcatgaattcaaatgctcagagggaaagaacatagatccaggagagaacgatcctagggttcaagactgaaccttggaacttcagcaataaaaggcgggtttaggagaatgattgaattagtccagcatacaagatgttcaacagtgttgctgggcaacgtcagggtagccatatgatttcttgtacaaatgaggggccttttgaaagtgaaagagtgctaaccaggagtatcaaggcaacatgtgtaaactgggactctgtatggcaaaattagacaaagcaagtagttagatttattcaggttggaattgtgacagatatgcacaccaggaaaataaagagacaagagaactcaatatggaattagtcatcaaatgccatctagttgacattcttgcctattaatctcttcctgcatgttactacataaactttccacactatgtattttttcatattgcctcatttttgttcaaaaacaacaatggctctcagttgtcagggtgagagtttagaatccctagctaaaaacccaaactcttagttcatctggcctatctttttaatctctcatttactttaatctctcattagctttcccgagagtcatatttgcctttttactgacacttaaacatggcttaagtatcatcttctctagacttttaataagtaattgaatatagtcccctttatgatcccagcaaggaatgagccttattgtctatcagtcatttgaatctactaggaggatggttcatccagcactctatatctgataacatcgggagcatcagtttccagggaagtacattcaggtaaagtgagaatgttgtgctggatgcgaagtctcagatctctcagatgaagtcccgttttgttccccacccccacctgccgtaatgaattctttaaccacctgatgggttctcctgcccactgcacaaacaaaattaattcacataattgcagaaaagaaagagtttaattgacatgaggccggccacaccatgggggagagggaattattatctcctcaaaggcttctagattagggggttttatttatatttatttatttatttatttatttatttatttattttttgagacggaacctcactgtgtcgcccaggctggagtgcaatggcgcgcctcggctcactgcaacctccgcctcctgggttcaagcgattcttcctccccaaccccctgagtagctgggattacaggcacccgccatcatgctggctaatttttgtatgtttgtagagatggggtttctctatgttgacgaggctgctcttgaactcctgacctcaggtggtccgcccacctcggcctcccaaagtgctgggattacaggtgtgagacactgcacccggccttggggtttttcaaagattgtttgggggaagtgatgggagtggctagacaatggttgtttgttgctgattggttgggggtgaagtcatagggttatgggaaatgttcctcctgtgtgctgaatagtttctggtggggccacaagagcagttggtgagtccaggtgaagccaggtgtcagacatgcaaagaacccgaaaagacatttcaaaaggccaatcttaggttcaataatagtgatgctgtccacaggggtaatcggggaagttagcataccttttgatctcttgaataatgactggcaatcctttatgtctacaccttagcagaattcagccccctctatctgcctagcctggtggtctctcattagctttacaaaagtggttgagttttggggaaaggctgttatcatttaacctataaattaaatgcctcccaaggctagcttggcttaagcagccaaggaataattaaaagcagtttgaaggctcaaggcaagaggggagttggctagatcagatctcccccactgccataattttctcactgttataatttttgcaaaggcagtttcagttctagtactctatctgggatgtaccttacttcacttacaaataagcacagatcatattttgtatctacataactaggcaagaaccatcctgaaagggtaacaaattctatgaatccatccaaatataaaaatattcacacgatgtttctgtaattccacacagttagaaaaaaaatcatataggaatcagggaggtgtattctcattcaataatagaaacaaaatgtctttattttgcttaaaattaacaggaaaaagcaacagcattgcagtaaagaaagagtttcattgacacgaggccagccacactatgtagaagagggagttattataggaatcaacagaaaaaagtcccagcccttctgttcacatgctttaaaaaaaactatcataacatcaaaattgaacttctgtcttcattaataatcataagctaccacatattatgttgattaaaaaaaaattgaaacatctgcttggattgccttaaggaagactaacctgttttcctgctaagggtgtttgcattctttgtaactctaaaggtgaaaggacatcaggggaccgcccccagccaccctcttattcatgttcctggatcacagaaaaaggtgaacatattttggtctgccatttctatttgtggtttttttgtttgttttttttcaagatggagtctcactctgtcacccaggctggagtgcagtggcacaatcttggctcactgcaaccttcacctcccaggttcaagcaactcttctgcctcagcctcccgagtagctgggattacaggtgtgtcccaccactcctggctaatttttgtatttttagtagagacagagttttgccatgtgactaggctggtcttgaattcctgacctcaaattatctgcccccctcggcctcccaaagtgctggattacaggccggagccatggcgcccagcctctatttgttattctctagtagaggactctgaattttgatttttttctttgaacgtttttttttctattgtagtttggagttgcttttaaggggagttaacgcatttgttgggctctaggtcactttgaggcagagaaaacttcaatcagacctcttagttttcttagatatctgaactcttaatctggagcatgcattttgtaatttaaataaaacttttccctttattttcttcaaaattatctttctttctttctttctttctctctctctctctctcttttttttttttttaaaagcagggtctcattgtgtcacccaggctggggcgcagtggcatgatctcagttcactacaatctcgggctcaagctatcctgtcacctcagctttgctagtagctgggacaacaggtgtgcaccaccacacctggctattttttgtactttttgtagagatgggggtttcaccatgttgcccaggctggtctcaactcctgggatccagcctcagcctcctaaactgttgggattataggcgcgagccactacacctggcccaaaattagtttcatttgagtttacatggggtggttgaaagttttggggagttttttgtttgtttttggaatcagtttcagactatgcactttttggtactgacacttttacacacaacaagatcattcatgcaaaaatgaagaaatagaaaaatgaaactcttgcttttttctcatctttctctggcttttcttctcttatggccattttctccctctttcttttttactgtctgaaactcttttcatagacttgaacactgcttagaattatagaactattagcaggggcaaattgtatgcatctgcaatactacctcaattcttgatcctcagaagaaagaatttgaccaagggggtgtaaggcagagtgagagactgaggcaggttttagagcaggaataaaagtttattaaaaagttttagagcaagaatgaaaggaagtaaagcacacttggaagggggccaagtgggcaacttgagagtcaagtgcactgtttgacgtttgtcttgggttttgtatgttgcatgatttggtgggttgccttacttctccattgattctccctttggagcgggctgcccacatgcacagtggcctgccagcgtttggaaggggccacatgcacggtgtgtttactgaagttgtacacatgctcacttgaggtctttttcccttaccagccaagtgttctaagaggaaggacatataccagttaaactccgccattttgcctcttagtgctcatgcttgagcccacacacataactcctgagatcttatcaggaagcggctgatcaccacttcaggtgtttcctatctattgggagactgcttttccctggtcactcacatccgtgtgaagagaccaccaaacaggctttgtgtgagcaacaaggctgtttatttcacctgggtgcaggcgggttgagtccgaaaaagagagtcagcgaagggagataggggtgggaccgttttataagatttgggtaggtaaaggaaaattacagtcaaagggggttgttctctggccggcaggggtgggggtcacaagatgctcagtaggggagctttttgagccaggatgagccaggaaaaggaatttcacaaggtaatgtcatcagttaaggcaggaacagaccattttcacttcttttgtcattcttcagttacttcaggccatctggatgtatacgtgcaggtcacaggggatatgatagcttagcttgggctcagaggcctgacacctggcactggcttaaaccaattgttattttagaaagacagtgtgacaactgcctgaccatcacccgacggtcgcctgacattcttagattgggggcccctctcctgctttcctcacgcctgcctgactacctactccaacagagcaacagcggacattaccagagtttttttttgcctaagagatcactctgcctccaggactgtgggttctgatgcctactgcattttatggagctcctttcctcagaagagtgttgacaggataaaaacaaatcctgggatcatgtcttccttgatatttctgagcaccgtgtatacatatgtatgtaatgatggactcacaaatatgccactcttatactcaatatttgaggtggacaatctgacattggaaatgtagacattgttgttagacctggatttcaatttttatgctttgttttgtgatgttgactgggctgtattaaatgtcttgagttttagtttcatgatctacaaaagtagagttataatttgaaggagaactgaaaggacttgatgagatgaccattgtgctgtcttgtacatagtagatgctcaggaagtgttggatcttttcttctcactccgtctgactctggactgttgtatagtcatagtcaaaaactttgtagccaaggtctattataaaactagcatattcatcataattatggcatttcatagcaggtggtatgtcacgttcaatgctcagctaagtaattgtttaaattccatacaaaaaacaagtatttttcttactctagtgaaaagaaaaatcttgcatttacaaaatcacttgaaataagaatttctggtatctaaataaaggaatataataatataatagttaatatttacatagcattttctgtgccaggaactgttctaagtctttacatatattagctcatttaagtctcatgatgactggctgcataattagtgaggtcagtccagtgaaaaataatgcaaagctgcttgttcaaaaattattaagaattttaacatggtgatgccagagcattaaactaagagtggggcctttctgattacagggcagtgtacaaatacccaagtgacatatctcaatcttcatatcaactctatgagataaacaccattattaattgcagacaaaataattacgaagtggggaaaagctaactcacacaaggctacagggacaggaaggtttggagctgggattctacccaggtaattagtgttcagagtctatgttcttacctactggaaaaaaaaaagaaaaaagtcttttgtttatgtactaacctttattttataaattgcactatgtattttatttcagagctatgatatcaaaatatctattttgatatgatcatatagtataccatattcatctatatcaatgccatggtttgtacaaatagaaaaagatctgatgggaagcattatccatgtagctagttacaccaaaactaatatgaattttaccaatcaccaaacactattctaagccctttacttatattaacatcatataactgttaataccaccctatgaaataggtactattgttgcaatcatagtattttagatgaggacattgaggaatggaagacatatatcttgagcaatgcctcacatctaataactgctaaggtgaaatttgaaccccaacaggctggttggggtcttcaaggtactttatgttagtctcttgactgtgatgaatgaaatgtgccattgttttaattttatccactgctaaatcaccaataatcagcagaatgcctgacacattaaataaccaatcaatgtttgatgaagtaatgaatgcactgagtcctttgaaaattaaaattttaatcatgcaagtaatacatggacacatgcttcttctaaaatgctaataaaatagtctaaagaaatcaaaccataaatgtcttaccagaccactctcccgcccttgtcatgattttaatctttattctctggacttttccaggaaggaccaagatttccaggagtgttctgtgtttatgaatcgctgttgatcatgctatgagccgacagggttgacgtttgctctgcatactcaatgcagctcaatatgatcctgaatatggtgaagctttcttcagagccatttcttttgctgcagacacataataaatgccctagtttcactaggcagtttcagtggaattcaatttgaaagctaaaaatgatgcagataattataagcagcttcaattccagttactgtccaatccctgcctgaaagctccttgccaagggatgttagccacatgatcctgtggctgctcaaggttaagctgttctgggcaagagtttaaatgtgctgccacagggcaggtttacttctttctaaacaactcaggctgttttctctagagccttgaagcccagggtctagaccagacattacaggattttatgtcaaagaagagtataatattaaaacataattggggcatcgctcatggttgttaagactgacttgtgataaaaaatcatgtgaggaaaaaaaactgccttttgggtaagctttagaaggtggcaattaaggaacttgagttttggagcaaaattgccttatttgaaatctaccactgccactgttgactgaacaattgactgattctgtacaatttactatattttctgaaactcagtttcctcatttgtaaactggagataataattgacttacctcataaaactgtggtaatgtcaattgaaacaattaatgtgaaatacctaatatgctgagattctcaataaatattagattttataagcttcataaaattaaaaagtgcaggagaaacaatttcagaataactcagtccagttggaaatattatgccaatatttttgctgaaagctggtgaaatcttcagcagggactggcagaaacaccagtgctttactaggcttttcttgggcataatattctcctgaagtaaataaattgacaaataaatcaatacattgacaaatgtcatttgtcagtaaaagtgacaccttctaaaatgaaggagttactcttttggtttcattgctatttaatggtatgttcagaagtgaactgacttattaactaatgtgatctgagtgactgtgatggacattctcctccaaagctgatagagtgcctacaacacttcctgctctgtaataggcacaacataaatatatagtgatttgcaagccaccttttggaggagaacacttcccattgtttttatatcttctaatacaccagtgcttggtaaggtcctcacaagagaatgctgatacctgcatttctctttccctggtttcctgcacaggctatggtgggcgtaagctcagttctcaacaaccgcctgctgaatagaacactgggcaagggaacaaggggttttaaaggcactgatagctctcaagaggctgctctgtctgccaagagatgagagccatagaatcagaagaaaatttggagaataaaaggttcagaaaggtgactagagtaggaggaggaaaacaaagagactttaaagcgctcttctcttgaagcaccatgtcctctcactatttattgtttatcaggtacccttagactggatactaagcaaggctcgtcaccacaaaccttgtcacatgcacattgtcccttcctactctttggagctaccattgtgtttgtgaatatcacacactgttcacttagatatagatagatagatgaaagataagatagatggatagatagatgataggtagatagtagatagacagatagatagatagatagatagatagatagatagatagataatagattaggagatagaaaatgtctttgtatttatctggtgatgggaaatcttgaagtttggagtcaacctgatttagttagggtaaataatagtgcttgctctaacaagttgagtgaccttgtacagtttagtggaaatgactcctttatgggcaacaactgctgaatagttgattcattatttttaaaattatgtttaagagaaaagtattctgaagatccgaacatctcttaaatatgttatgtttgcaaacataggaatttattcaccagtcctttgatggagacttaaagcttttcttgtgtattggtgtactgtttaaatttcttacaaaactcactcccatatataatctatacatgtaatctatgatttctagcttcagtttctttaaataggacaaaaactaaaactctttgcaaattatgctgtggggaaaatttgacagatgtttaccacacaccctctcccaaacagatttgtgaaaatacagaccatgtcttaattttttttttttttttttttttttttttctgagacagagtctcactctgtcgcccaggctggagtgcagtggcacgatctcagctcactgcaatctctgccttccgggttcacgccattctcctgccttagcctcctgaacagctgagactacaggtgcccaccaccacgcccggctaattttttgtatttttagtagagacggggtttcaccgtgttagccaggatggtctcgatctgacctcgtgatccacccgcctcggcctcccaaagtgctgggattacaggcgtgagccactgtgcccggcctcatgttttaattttgtatttctccctccctccctttatctttcctttcttccttcctccctcccttcctctctttttcttcctctatctcttcctctctccccttgatcacagtatatactgtagaaccttgtatatagtagcatcatgaaataaaggaattaaattaataatgggtaacttgcctactgtaacacctaacaaacatataatattcaataaaaatgctgttaccattattgttgtcattatatgtatatatgtttatcattatgtttctacagaagcaaagtaaattggtgtctttaagataatattaaagaaatggctaaggaggcttacatgagattttcagcaaagttccaagaattgaaaaactataagtagcagatgcaacctagaattccacttaccttatagtgataaaagacactacattagtttaagtttactagcccatcctgttgaaatatgtgtgctcatatattttagtaatacttgtatttttgtggtgaaatggttatgcttccaaaaataacaaattccagtgattttagttcaaaacagttaagagctagagctagaaaacaactttcttacttgcattatttttctttacattttcctaaactatacgcaggcaaaaaaatgttgtggaagtgctgttttatggaaaaaagccctgaggtgctatttgcctgcatgctactgaactgagtttacatctttgcaaacaggaggcttcccggaatgtgctgtgtgtatatattcagagcgcccctgtgttcactgttttaagtattgggttagagatctcactaaacaataaagtagcattagctccccgtagacaggtaatcctattatctttagatacaaggatacattttaataatacagatacggagattaaagcaggaggattgagaaagcatcccattccctcagggataatgggtaatgtaatcatgctcttgcactaagcaaataaattagaagtcttgattgcatcacaatggaagagattcatacttccatttctttcaaaagtgatggcagtctgcttccaaactaaggccatttaacatgtctttatacattttttcctagtttttgaaaaatattttaaattgaacccaaaggcaaatacgtataatgctagttgatgctttgggggatatatctttctatagaaaccttcccttccaatgccattgaaaaccaaatttcaaaattgagcactagaagtaagccaaaaatcaattaccattgatggaacaaaaaaaaacagtacatttttgtcaatattactgctttctttttttcttttctagctttgaaaattaacccccattatgtatgacaatctctaaactaaagaaacagtaaaactcttgaatatattctttgtacagcctttaagtaattaatggagtacaacacagtggtctcgataaaagttccagaagaactcaggagggcaagagatgctgtagaaaggagagaggatcaaagctgtgtcttgcaaaacagaaaagattggggcatgaaaaaggtgtggagcaagcaaaggtccaaaaaattgttccagaaaaaaaactgactaaataggaatgtaggaagtatcaagggaagataatttgggcagattctgaagaacctttagtgccttgataaggaattagactttaggatatctggagtatctctcagcagggaaaaatcttgatagcaatgggtttgagaacatgaatatgggaagggagggtaaggcaagtcatctacgaagtaagaaggccttagttttgaatattaaatgataaataagaaaaaatatgaaaaatgaacaagcaagactatgtagatggccgaatagacagaggccccccccaaaacttaaccacaccctcatctccaagagcccaggtgttttttcctatttatcatctcagctgctcaatggctcatgcaattttaaagcaagaagaaataatgaaataatgatgaagcagatgcactgtgtaagtgcacacagggatgaataaattatacaaaatgcactgcagttggaaggaaggaaaggaattactgaaagaaagtagcttcatggttttctcattgagatcaaactcagtcctgctcagtaaaaacgaactaagtactcttggtctggaggcctgaccaggaccttaggaacttgtgatacaaagactggaagttgccctggttgagtcagtgagtgagtggtgaatgaatgtggaggcctagcacattactctgtacactctgtagactttataaacactgtacagttaggctacactacgtttgtaaaaaaatattttttctttaattgtaaattaagatagcttgctgtaacatttttactttataaacttgtaattttttttactgttttgtagtaatacttagtttaaaatacacattgtacagccatacacattgtacagccatatgaaaatattttctctctgtatatctttatattataagcttctttctatgcttataatttttgttttattttctacttttaaacttttttcttaaaagctgagatataaccatatacactagcctaggccttcatggggtcaggatcaccaatatcgtcatcctctactacatcttgttccactagagggtcttcagggacaataacacacatggagctgtcatctcctatgataacaatgccttctcatggaatgcttcctgaacgaactgcctgaggctattttacagttaacattttttcttttaataccgtgtactcagaaagagtatactctaaaacaaccataaaaattatagtatagaaaatatattaactagtaacagagtaatttcttatcatgatcaaatattatgtactgtacagaattgtatgtgctatgctttcttttttttttttattttttattttttggagatggagtttagctcttgttgccctggctggagtgcaatggcatgatcttggctcactgcaacctctgcctcctggattcaagcgattctcctgcctcaacctcccgagtagctggaattataggcgcccaccgctacgcctggctaatttttgtatttttagtagagatggggttttgccatgttgaccaggctggtcttcaactcctgacctcaggtgatccacccacctcagccccccaaagtgctgggattataggcacgagccaccgcgccctgccccatgtgctatacttttataggactgacagtacaggaagtttgtttataccagcatcaccacaaacacatgagtaatacagtgcactacaacatcgtgacgaccatgtcactagatgatgggactttttcagctccattatgatcttatgggaccgcagtcatatacgcagtctgttgttaactaaaacgtcgttatgcagtgcatgagtgtatttgatgcaacacagtcatctcaggaattaaagtggctgtgtctaagtcccagtagccctccgttttgacttatttccttttcctcaaaaattagatgccctttcaacctggtttgacaaaaatcactgaaattgatcaatgcatataggttttgggtctatgaaaaaatgcatattttagctctgaagagaacgataacagaacttgactgggagttgtaaatgtcagtgaataacgggttatgggacatgaagcatattttcagatttctcagagaaccatacttgggtccaaatgacttcatgttaaagaaacggaataaaatcaactcagcattcctgctgaccagctttctatctcagtaagtaagtcatcatgccctccggagcaaccatcttaggtcaatcaaaacatttggcctcattaaccactttggatttatcttaggactttcttatttatagtcttcccaaggcataatgggcttcaaaatgtacttttccctggttcatgttgagttgaaccaagttctgtgcttttactcagcaggcagtcatttgactgtcagcttttatatttttctctatgatcaaggagttcatacggctgctcctaggtgcctaattaacattcctccatcactgcatccctgcttgtaattattcttcatgccacctttgtttcctcaaccatcaggaatatatcaataggtcaaatcgttttagtacttctgacttagctcttctttaagcttcataattattagatataaactgcagataatacagatctcttatttcagcagattctgtgattctgctttttgtttgtttgtttttgtcaggagagaaattggactaaattctgaagagtggccatggtttgggaagatagaagagggtgctgcatatagggatattaggagcagagctaaaaggcaggaatcaagttgcatgttggtgaagatatgtgatgtgttcggtgtagagaggtacacccttgaatttgaaatgtaatatggtggggggaggggtggaataatataaaccttagaataagagtaggtctaggaagctggtccccacatcttcaactcaccttacagccacccagcaggcagacttatctcccaaatctggtccttttactctcttactctggttctttcaatgagactccagtgccttcagctaaatttcaaatgatttctcctgccattctagacattgcaggtcccagcacacatgagtttcctaaactaatcttcagtccttgctctcctgccaggcacctcacatttcagccacattcagtacatccttgaactcaccatgaacactcatttccacattaccacccatgtgctcacttgctcttatcttccacctccagtgcacttataaactcctacacagtatataagatacaggtaaaatataagtcattgtttgtatcattcctcagtcatagctatttacttcactacatgtacatccgatacccttgaacatatctgtattacaccatttaccacaacgtattatatttatgtacttacatgtctaatctgccacctagacttgagctcagcgtttttatttatccatgttccccttaaagattctcatatgcctgatagatggcaggtacctaatcgatgtttgttaaagtgttttggatggagaatcactaccatgttctttcctaaaaaatcccaggaattggtggtataacatgactggtcattgttaattaatgttttctactagagattgttcttagtcagtcttcatgattttttttggttaacaaatattttggggattttaatggccaaaattatttctaaaaaattgcttctgtggttgttggtcattcacttagaaaggatttactgaacacttccaattaatgagctaatttcagttttctgaatcacaacaatatttatttcccaagaagtaaacaaatttctgcatataaattagaattttattaggtagcagttttataaatcatgtagtttagaatggcattctcctagaacaaatccataggtcttttttagaaaaaaaaaaaagaaaagaaaagaaaatgtcgcctcaataattttagatgtaatttccatacacattttattgttgtgtattataggttgattactgctcctgatagatttttaagttgcttaagcatataaaagccccaatataattttccacagatagatggagagaaagaactttttaaacgcaactctataatttgtatatctgaatcctgatcttttaaagctttcttagtgttttccttagcagaaaaaatgtttatcattagaactgttaaggaggaatcatatctccttttataaagtgctttatttttcaaagtaaaggaaatgcgagatggcaccttataaaattgctgatcaaaaatggtcaaatgttggcagtttcatgtggttcaccctaatacttacagcttgattttttgagaggaaaaaggattgaaggacgtaaaaatgttatcttccagtaatctcaaaagatacctgagagagaactatacagtgaatgctgatgtactgattatgaaatgtattttcataaaaatgactgtaacctggttaaacaaggcatttttctcctggattctgcacacactagtagaataaattcagttggtttccattcctctgtcagttagtgcacgtaagtctcacccatttgtaatgtctagaaatcttaaaaagcatcagaattaccattaatgatgatgatcacagtctgctagatgcccaggaatgactaaagcctactactaaagccccagtagcagtcaatataggttatgcttcaataacaaacaagtacaccaaatccttatagcataacacaatgtttatgtttaaaattgtgatatgagttgaatgactttccagagcagattttggagggggagaatactcaattatgtacttttcattaccacaaactgaagtggcacattctcagttctagttacattttatttgctaggactctggtctcaactaattggaagacgaaagtgaagtacaatgaatgaagaaaggagaggaaaatcagatatggttgagcactaaacatctttaccatagtttgtaagactaaatagacttcgtacattttatttagtatttttttcattcttgcttggggaaatctttccaagatacattgccaaactggggtaaatgaagatgaaagaaagtctgagacctaagaggttgaatttcttgaaactattttataatgaccatttccttacttctttttgccttgttgattctttccttgttcattctatttaccacaccagacataactccacatagcaagattttgccttgtctgatgccttcattttcataatttatttccacacatataagcagaatgggttacaatggcagacagaaatctttagctttgaaatagaatggccagtgagaagcatgcctatatgaagaatctcatatagagagaaaatttaaatttcaatagagtgtttttcttaaacttagaattggccacttttttttttttttgtcatttcttttcacttcacaggaacatagggaaatcttaacttcagaagcaatttgcgtgcaatctctcttcctggatgggtgaggattgcccccttcagctcctgctaagctttatcaaatggagaaagcctcatttcatgcaggcaggagtggagagtggctctagtgtgcatgctatcctcatcctccaaaatatttcacataaataatatgttaccatcagaaacataaaatatcaattatatattataaagcagaatttataattctacatagagtgtaactgagcaaaaattccattgaggtataaaaacagaaaatgcaaagaatctttgctcatatgaaactgacaacatgccatctccccttcatatgactaaacctgctctcccaatcccattgtaccatttggagagatttacatcaatccagaacaaaaattactcactttaccttaagtattgttagcttccttatttcattgtatttcttcagttccttcagtttgtttttaactgaatattggtttctattggtttcttcagttattttttaaatgatgtaaaaataaagtttatctcatatccctattaaaatctctcaacactcatgtctccctgacagcccctgctcattctctttcttccagcctggtacttccttcacttctctccttcctcctctttctccttcttctcctcctctttcttctttctttttccttgtctttctcttgtttttattttccttccccctcttcttccctcatctggaagtggcttatgatgcacccgaatcagaatcccgacgaacaaaaattatgattatctcaaccttaagaaaaacagctggattctagaaaaccctcaaagaaagtacgagatttgggaaagaagcacaaatgtcccccaagtccctaccccactctctcatgccgagaaaaaacagcttcacaacacaaagcttttatgaagggctagcagttccagtgatgggctcctgagccctgagcctaactggtgcctgttgacctcactgctgttcaaatactgtcttcttgtcctaaaattagacattacctttatttgattttctctggcactgtctgcctgccaaccagctgcctcccctgccacccccgcacacactggtgatgcattccagatccaaatccaagtcctggttgctgacatgattccagatctcactgactgtgggatttgtctagaattatgaggccaagtctcatattttgagatatgaagaggacagaaacataaatagacccagaacaggatctcagtgttacttttttatctgtgtgaaggacaacgatctctccattttattctctctttaatacctatttccaaacataagaaactggaacttatgatgtgcctatagtgtcaaacattgctccaggcatggtacttgcactgtcttgtttaattctcacacaaacctacacaagaactgttatgattctccttaattgatgaggcgccaaagtccagagggatcaagtaacttgcaaaggctcacagtcatgtggctgagcagaggttccaatccagggcatgttagtgcacacgggctcttccctagtgccataattcctcccctcaaataagattttcctggtaatttgtgttttttgaaccaataagacttaccctaataaaacaggataaaaggtaacaattggcaggcgcagtgcctgtaatcccagcgctttgggaggccaaggtgggtggatcacctgaggtcaggagtttggccaacatggcaaaaccccctctctacaaaaattagccaggcgtggtggcagagcctgtaatcccagctacttgagagtctgaggcaagaaaatcgcttgaacccaggaggcagaggttgcagtgagctgagattgcatcactcactccagcctgggtgacagagtgagattccatctcaaaaaaaaaaaaaaaagtaacaattaattccatttatatgggaaaactagatatagagaatgtatgcaatttgttgactcttttttggtaaaaagaactagtactagaaattcaaactttcaagcttctagttcagcactttttcaatgatattgatacaagatattttgctccttagctcagctaatctgggttcttgtctcaagaccaggaagaattaggcatgcagacacattgaagggtgagaaggatggaatgtattaagccaaaaagaagctctcagcaaagagaggaggtcctgcaagcaggtttccacctcccaaattgaataccagggccaccacacaggagacaaagaggccgagctccttccctgcataaggcgtgaattcctggtggctccaccccattccccaagtacaggtgggcctctagtccattgtgggcatgcccaggcaagccccctgtgcagttccctcatctgcacaaaacatctggtgtaaacacttgtgggatgggttggagattctgcagggattcttccgtatctgcgtaggcctttgtctgcctcctgcctctatcaatatcttgatgtttagaactgaggggaaaaatatatggtaatttttgagactgtgaggcagagctacttccttcactgtaatattcatggccctgaatgctggccaacagagggtcaggacacaggaagggaagcagcatcttatagatgggccgcccctcaacactgtttgctgcgctactcgatgtcactatagaagatgttgctctaccccaggttgcctctgcccactcctgtcaatcttgtttttcacaattaattattgacctatttgatcttcctaatttccaattagccacattctactttgtccaatttccccaatcctatcccttagtataaaatcctgctaaattgcatttttttcaatctccctaagtaatgtgatacatgatgtcaagccaacagcattcatttattttaaataaacttacagctagaaattttgtttctttaaccacattgctagacttgaataaagtattttatttaatgaatggacgatgatgataattgcattttttaaaagagcaaaggaatcattaggtattgcctgttttccaacaatactagattttattttaaatatgtcataattatttctacctgaagagcactggcactggagctagcctgccctggtacacatcgtggctccatgtcttaccagcggtgtgactgtgtgtgagttactaaatcactccgtgcttaggttttctcctacaaaacaaagataataataattcctctattatataattatggttagatgcaaataaaattgtgtccagaatttattccttctggtgggttcttggtctcgctgacttcaagaatgaagccacggaccttgcagtgagtgttacagctcttaaaggtggtgcatccggagtttgttccttctggtgggttcactgacttcaagaatgaagctgtggaactttgaatcgagtgttacagctttaaaggtggtgcagacccaaaaagtgagcagcaactagatttattgtgaagagtgaaagaacaaagctccctcagtgtggaaggagacccgagtgggttgccactggtggttggcatggccagctttttattctcttatttggccccgcccatgtcctgctgatttgtccattttacagagtgctgatttgtccattttacagagtgctgattagtccattttacagagtgctgattggtgcatttttacagagtgctgattggtgcatttagaatcctttagctggacacggagcgctgattggtgcgtttttacagagtgctgatggatgcatttacaagcctttagctagacacagagcgctggttggtgcgtttttacagagtgctgattggtgcatttagaatcctttagctagacacagagcgctgattggtgcgtttttacagagtgatgatgggtgcatttacaagcctttagctagacacaaaagttcttcaagtccccactcagcccaggaagtccagctggcttcacctctcaaaatgatataggtttgggggaacttttaaaaatttgggcagattattttttggcagttattttttgttgctatgttttatcttcacgtgtttgtgtgtgtgtttgtgtatttcttaagaatactcaaacttggctgggtgcagtggctcactcctgtaatcccagctctttgggaggtcaaggccagcagattgtttgaggctaggagtttgagaacagactgggagtatagtgaaaccctgtctctactaaaaatttaaaaaattatctgggtgtggtggcaatgcctgtagccttagctacttggaggctgaggcaggaggatcctttgagcccagaaggttgaggctgcactgagtcataattgtgccattgcaactctagcctgggtgacagagtttaaccctgtctctaaaagaaaaaaagaaagaaatgctcatgttcttggaataaattcatttttataaatttattcaaattagttatacaaaaaactatgaggaacatatgtctgtaagaaggttcatacaacctcattgaacatgattgctcctagtaggaacttaaatagataacataagacaacatcaataggattttaaggcagccatttacaattacaatctcattttaaggcagccattttaaggcagccatttacaattacaattacaatctcaaataataattttataaaatagaatattgtatattatttagaaaacaaattacacaaatgacttcaatttacattaaaactcatatgtacattggacatgcagtaagaatatgaataacttccaaattttctgcagcgagcctgtatcaatttaaaatcagaatttatgtgtatgtatttaaaatatatatttaacgtaattctaccatctgacctagtaattcctaatcatttaatgtcccatctaattctttactgttgagtaatttgatttccgatactgtaatttattaaaataatgaagaaaaaggaaaaatatgtactaacatgtaaatttcagcatgatatataagactagaaaattgaaacacaaaggaacaatagtcacggaatcgttaaatataataggatcgcagtttaatatacgagtatgaaaactcatatgttaagagagaaaaactggatacagctatatgtgtgtgcatctagatatagactaaaatatatttttaaaatcctatggctatgactagataaagggctagaagaaaatttttgtaagttttgacagtaattacttctggggagaggtgtttctgttttctctctattcttcatttccaaaattttctcctattatgttatataaatttatagcgaggaaaataaagatattttattaaatgtaatttcttaaagaaaatattttattttccttcttccattgacaagttctctaaggtaaattttttctgactcctcccagatcacgtgtccaccattttattttatctagggaatgacaacctcacttatgtcattttgaagtactgcattatatgatatttggggggaatggcctctcccttaaaacctttacctgcaagcttcctctggagtctttttgagtcagcacctccatctgtggtccaagatgaaaaaggatgtactaaatcaccttgacagtcgtctgtttgcattatatcatcagtccctgtcttatgtgtggatgcaacatttcttcaatccattctttgcctctcctaagtgcacacattctcaggcagaatggagaatcactttttgttttgctataaaacacacactgacttttgagacaccttcccagaatgtcccagcaagactattattaatttttaaacagagataggactcccaagaaggaaaaccaggccatggtttacttcgcataatttaactgcttaactcaaaatattttccctagagaccatcacggtagtgaaacttttcctattataccattcattgacaaatttgtaatcatgatgtatgtgtatatacttatagtatatatttaaaatgggcattctgaccttgtagtttataattacaggattaacaaggctgaaaggaaattatgtaaattaggaaataggacaagagtgagggacaaacctggaatgatgacaagcacagggaaagatggttaagggaaaaaaaaataacttcctcttttgctgatttccgtattgtctagagctagccatacttagaccagcaaataagccaatctttttctgatgtttactcagcattttctgaggctctcctagcaacaagagtgttgcagggtgctggtcctgagaaggccaagcacatgccccctttgtggaactcttggtcaaatggaaaaaccaagtccaagagtcaagcaaaaggccaagagttttgacagaatgctcacaggagtgtgttcaactttacctgggaaaaagaaaatgagcaagcagagagatatgactttgtcttagtgaatctgaccgttttcaagtaaaatgtatagcacatactttgtccagtttgaatggtgatatattgcaaattaaatgaattacttaaaggccactgtttatgatttaatctatgaaaaacgtccctccattgcatttctgcatacgttaggtacttctgtcagagcatcttattctgctagtttgtttacacttgtttctctctcttctgaactgagactttcaaatattatggtacaactatcagatgctgatatataatgcttagaaaatgtagatgaagtgggaaaacaaaaagtttcatatttggggtcttataaattgctcctgttttaaggaagatccaataatcaaacatacttacaccactttttgttgttgaattcaattggcataaaatgacaacacaaacacaattttaacatgattgaaattgttggatgatgaagtaggaaaaagtgttagggaagtccggaaaagtaaacctaaacctgcttaaggtaactggaaggaatggaagtggctgtcaaactgaagaaaagttttgtaaaaaaaaattacagagaaatccatattcccaaggtgatctctggattttgtccagaagactcaggcagctagccatcttgtgatgatcccaagaaattcgttcatgaactttttcttcttagagaggagaggatcacacatattcattttctatgaccagagctcagagatacaaacaaacactacgtccaattttatgtcagtagattgtctaaaatattcagagtctggatggataaaatattatattaccaacaaactaaaggacttgtgggtactccaacagcacgtgggcaattggaatgatatcctttttaacgtgactttagtaagtcttaaattgtgttagcagcataaatatgtgggaagtggtaggaagcagagaaaggaggacgcttgctggtagctgggtaggggcagggaagttgaggggcctccagacctcatttcagaaagtcattaggaatgtgtcactctgtaattggcctgcgtttctgggacccgtcagtatctgcctttttggatcaatgtgtgatttttgaggctgtgacagtcccgctctgagtgggttgcaggtgaagcacagttgccctgtcttacgaaagggagagggttggcaagaaaagtccatctgacattgtaaacagctaaatttatcaaggcaacccatttttcagctatacagaactgtatttctgtagctgttttttaaaaatattatctaataacctcctagatttttctcacttcctacctatggtgaaacatgtaaataaggagaacccaaaagcatctcagttcataacacgtttgatttttttgtttcttttctttggaaatgttcttgcatgaaccatttgcacaatgccaggataaagccagttcaaacagatgtgaattgctgacttgatcatgagaaaattagaaaaaagttacctaatgctagtgtaaaactggttagtgtgtgagggtgtgcttaaagaagcaggaaaattacacaagacgatatgagtaccccaccttggaatcttaacaggggaaaaagtctactcattaacatatgctttaaataatccaaaagattaaataataccatgataaaataacttacaattgcaaaaatgtatttttaaagtacaaaaataccagagaaaacatttttattgatctacgtaagccctattaaataaattattttgcagagacattatgcagtcattgggaaaatgggtttaaacttcagtcagactcagattcaagtcttagctctactgcactcttgttctatttcctaagcaacttaccaaaccttttggagtctcagtgttcttatctgtaaagtgctgataatataaatatctagcccacagagcggttgtgaggaacaaaggagaacacacataaagtacctgggttatagaaagtatgcaatgtatttgcgtcagtactgcttctaatagtactcagtgccactctccaaattccacaatatgcttaacactcaaacttatttgatgagaagatctatattttttctactataccacacctgtacttcacaatatttacattgtttaaaaaagcaaatgttggtctcattgatatttctatggctaactcatcatggaaatgttgaccatataaccttgtaatgtcttattaagaggaagtgggctttccaagggcaaatcaaagttttctgaaatacgaatgtattatgggtctctgaagcacatgggcattagggaaaacttcatcccaagatcctgaaatggattaggatcaatttgtgttaatcttgaagtaattgtctagcccagggaagttcctgttaagaactcacttaatgattgtggaagaaaagaaagaaaataaaagaaggaaagagggaaggaaggaaggaaggaaggaaggaagcaagggaggcagggagggagggagacagggagggagggaaggaaagaaggaaggaaggaagaagggatggagggaggaagtatcaataaattaattactagttataacacctgaggatcatcttcttgcgcaaattatttttaacgttctttagctacaggcaaagatcatcctcatcccaccacttttgtccaaaattgtagctgcatccttgttttattgtcaagctagccttaagacctcgttcctcccttctaaactattggccaattctttttttttatacttgaaaatgtgccctttatctaatacttattatagcaaatcatgtcgatctctaatggctctgagcagatgcgccctacttggtgcacttgttccactccttgatgcagagagactgtctctcttattttagccttttgcatttaatgctttatatttgccttctctcccacccctatggtccatggccccagtaagaaggcaatatccatgaattattcttctccagaacacaatactgcacaaataaacattttctgattttcaaaacatttgtgcatatatggatgatctgtgtgtgtgtgtgtgtgtgtgtgcattcaaagcacacagcatgatttctaacatacactatgagtgcataacttggtctatgcattgactcagatacaaaataataattcaggaaaaagaaaggtattcaagatgaagcaagataagccatcacactttgaccatcctcaagaagaaattcaacagggtaagtacaattagggatatggtatttcacgtgtggtggtccagcaggatgcagcccatgtgaacttactttcagcgcttgacagacattgtgagtgaaaattattttgatcaaagtcttaagttagatcgcacactaaatatggattcatctaggttacatggtagactgagaaatccattgaaaatttccgcccgagaaaaccagcttgaaaataatgtaagtcttgtcactcgaggagacttggacatattaaaagagtttgatgtggaagtttggaaagcacctataccaaactgaaatattgccaagattattaatgcatcactttgatgagccaagaatttccatctttccccatgggagggatgtctccaatagttggaggtggaaagagggcacagcttttattttaagaataaagaatttcaaaatgaagaaaagaattgcagctaggttttgacagagcctgttgagaagtggaggcaaacatgatgttttataaatgttggtattacaatcagatcacttttggtaggtgccttctgattgtctaattagtatgatgtcagctgggcttgagaatcatttcttttttttaaaaccatctgttttgtcataaaagtttctttagaagccatatgcaggcagagcatttatgcttttgttttttcaaagtgatcttctgtgttctttgtgtctacatcctgtggcataaatcgtagttttaaactatctaggaagaatgcaaggagtccagcagaagaaataaataaataattggccaattaaatcaattaattgaaaaatcagtgatcttggacacaagggaacacgtcacctttaactcgtgtcacaggaagaaattatgttttcaaaatggtgaggttttgaatcatattgccttctgagcctgaattttcctatttaaaaatgggagatttggtaaggaattaattaaactcacatataagaggacaatgcaggagaaactctatattataataaattatatattatagatgaagatattttataaagtcttaaatacaaaacaaatatcagttataacaattgtatatattttaatcattataataaacatttattaaccactagaaagcaagctagtatgagtcattaaaccacaattttctaccatttgttacttcaaaacttcttcccttgtcggtttcttgtacatgtttgctgaatgtgtacatacatgcatgcatacctcgtctttctcaagctagtgaggttaatgactataaaataacattttattttccctttactttaaacttttcccagcataaatctgtcagtcaagtactcctgcctctcgcttgatcagaattacatggttgttcttgagtccttttgagatcccaagagtctggtgacatatttgtaagtcacaaggaattaagaggtcaagaacatcaatatcagttcaggaatgtacggatagagccctatgatcaagcaagaaacaccagctgtaagcaccattcaacgtacttagaacagttcaataaactctgatggatgatgaaaatttcaaaagcatactctacacaaggaacataaagcaatctttttggatagtcaatttcttggtagtaatagtagtagcgttaatgttatttctttacatttgttgagcacttgatgcttttctaagtgctttaaaacatgttatctcagaatgtttagtccccaccagtgcatcccaatttgcagatattaactttgagctatggcagcaaacagctcaagatctacattagctttcggtgtctaagaaatgcaaaacttcctcattcttcttaccatgtaattttccaacatatagggatatattagaagcctggagactcagcaacttgccatctcttacaaaattaatgatggagttagtatttgaacctgagtcttctgatcttttcaccagcatgggtgctgttcaggctcacactttggatcaccctgtgaggctgatgctggctgtctgtgaagcagcaggaggaagagaaacaacccacagcacagaaaacagtgctgctttgaagagtgggtcacaacacgattgccaggctgtgatgcatctcatcttgtaaaagtaaatacttggcgatttccttgtggattccaatagtttctcttgtcacacactgactataacagctgcattcgcttcatgaaaatgggttagagataataaattgaccgaaaatatagaagactgaagtttttgaaagcagtatctggaaacaaattgtttataaattttacctctagaattttgaactccagagcaactcaatttaaaatttggaacaacgataattaccaaagaattttccacagccttaaactagtatttcccaccaaaacagtgatacttaaaatgcatatgaagtaatttattttaggagtattgtgcatattatgcatacacacaaacttacactactatgtaactgagaaacaagaacttgacaaggtgcaggtcaggctaggggtgagaagttggagtgaggcagatacagtgcgactggaagggaacgcagtccagaacagaatcaggtgttgaaactatcaggaagcagtgaattccaactggcacaagtgttgttgttgttttttctcatctccgacttgaaaactgaagggacacacgagtcctttgatgattccttgagtgatccagatgtactgagctggggatgttttggaagagggaattttctgagtaaataataagggacaatatctttgtatcagatgtacataaatgtgataaacatgctttgaaagtgctgtagtcaaattcttaaattatgataaccgagaaaaaagttaagaaaaatggtatatgtataataatactatgttcagactccactgtttctgccattttttttgttgttattttatctattttttcttggtctccttcctttcttctccttcctttcttaacccttccttccttcttttgtctttctctctctctctcgctcactctcttcctctttttctttcttactggcagtctgagtggtaagacagtgctgtatatacagaactgtatcatagaagggaacctagaaattttctagttcagagttttctaaaatgcattttataataaattagttgtatgagatatttttagggggttctatgctaacaaactgaaagaaacatggtgttttatattcctccttagaccttcaccatatatattggcaaattaaagatgaaacattttgcaattaagataactacttaattttgttttatctatttatttccaaacttacactcaatgaccctaacttggataataccaaaagaacttaaggagctagctaccccaaatcactgttgggggaacagacgatttattctatcttgctactcactgcaggaataacatgtcagcactaatgacacatatttgtgaatatgtgttttgggtactgtcaggggctctgagcaataatgaaggaagaaccattcaacaggcacccttttatgggtcagattcgttcctttagtgggctcttttagagggttttattgttaatttcctaccaacacacttgctacaatatattgtataagaaattcataagttcctgggctaaggcatttggcctaactgtctaagccgggatgctgtctgacagatttttcacaaatttatcacactgagtcattgtaagggaattaggaccacaagagaccttctttttggtcctggttaggatctgaacatcagatttctgtttaggcacccagaactggttaatcaaatcataatgactgtattccatactgttattcatcggggaagcatatttatctgagtatcagataagctaccttttaattttttttaactgctatgatgtgccacttaaacgaatgccaagactttgtgcttacaaaccttctacccacaaagaatcctttatcttacctttgcataattgacttatttctaattaaatgtggtatagaaaaaaaaagacctacaaaatttcaacttctatcatttgttccttcctttaagtctctgtgcttctgtaaacatgttagaaccttgagcaatgcattgtccatgctgctagctcttcctttcagataggtttcatgatacattccaccaaccacaacacacacacactcacacacaaacacacaccatccagatctttattctatttcccgattaaatgttcagaaaggcagtgcaaggccaacatctaagtgtgcaactcaagacttctgtccaccttgatattattcagcatttttgagggacagttggtagttacactaactataaatctaccagactatatcatactccttcatcttgcccacaaggatatcatatgctctgctaaaaatcaagaaacactctatctaattcttccagtttaccaatttaataacactaccaaaggaggaacttgtactagtttggctcgtcttattattccaatccatgagagaaatttgtaataaatcttcattgttttatgtcatgacactcccggtattatttatgcaattctgttttcactgccaatgtttcatatcaagtaaaaatgttttcatatcaaataagcatatttgaccactatcaggctattggcatctctttatcttctgaaattttgcaaatattacctcataattattctgaatgctatttgcagcttgtccatttgtaaagaatttgtcattcaaaatattttaaaattttcatgtttgagaattaattcaactcataattcaattttatagttgtttaaaatcttctttgtaaaagaatatgctcagaatattacatcaagaaggcaggttggacacatacacctatcttgtgcctatctcacacaaatcactgaataatagaaatcatgcaaaaagtaaaaataaattgataatagtgttcacaaacaattagggggcagcaatcatcagacagaaaatcctgaaaatgtgttgcatatggaattagtttgctggagaaacaagagtaagccttcatttacatatggaaaaaaactatagaaaagggaaagtcaggttctgtaatatttgaattttgtgatcaacagatacaagacaagccctctggactggtgcttctcaaatgtcagcgacacacaaatcacatgggaaaggtgtttaaatacagtctgattagaaggtctggggtggtggccaagtgtctgctttgcatgttagacaatgctaacactgctggtccttaaacatttctttgaatatcaagggtcttgatcagaggctgtggggggcagagcccagcaatctgtttgttaacaagtcctccagggcattcagatacatgcttaaatgtggaccctctagtagttaagtgaacaggtgcattgagttcagctggcctgttacctacatttaccacatttccattccctcccctaatccaagctgcagggtccacaagtgttttctctgaggcttaaaaccctgtataactctggtctcagaagatattaatcaatgaccctgaggagggcttacagtgttgattcgttatctgaggtagaacaaagcaaatttggagattacctttatccttttaccatctacatgaaggaggaacaaagaaaaggcagttttgctgagggagaaaatctatccaagtgatccacccatgttaaagtgttttttattttggcatttgcctgacagggtctgaagcttgcctgccactttcccattcacgtttcttagaattagaatttatatggagcctatgtctactttcatacaatatatgaaaacacttaagttatcatttaaggtaaaaactattgattaaaatatgtttatcctcttatcttgataatgatgtgatggccaggtttatatttagaattttgtgctgcctggagttccacatttgaatgtggagctgtagggacagctccaacctggcctttaagctttcctcccctgatcaaccacccactccctttcttttcttttttttatcaatctacagcatttggactcaacattttgcaagtaagcatatcttagggatttgtgacaatcttttcagcaatagtagctcattagagtggcaatgctaaatgctgcctgtgggtggttagggcaacagaaggcatacctccccaaaatgacatattataatctccagggagacgtgtgaaatttgaaaaagcttccaagatgattgcctagttaccattttgggatttgaaatctttatatacgttatttccatgccctccttggttaagtctccagatggagtaattatttacaaatgtcaataatatttacttcaaatcttactatattaacaaaaatcataggcaacgttaaagcctcttgaacaaattctttcttccttatataaatcttgtgagtctccatcctggacaagtacttgtatatttttttcacatgtggggctgacactcagctgatatacaccacaaaaacttatttgttaaacaacattatgctttataaatctaaccatttagaaatgatacatgtatatcaagtttattatttttgaatattttattccagacacccaatcaaaaagaaatataaatttgaggttgggcgtggtggctcacgcctttaatcccagcactttgggaggctgaggcaggtggatcacttgatgtcaggggttcaagaccagcctgaccaacatgttgaaaccctgtctctactaaaaatgcaaaaattagccaggcgtggtggtgcacatctttaatcccagctacttgggaggctgaagcaggagaactgcatgaacccaggaggcggaggttgcagtgagctgagatcgcaccactgcactccagcctgggtgacagagtaagactccatctcaaaaaaaaaaaataaaataaaataaatatatatatatatatatatgtatatatatttgatatattaaaaaataaactatattaagaaaaacaaaatgaatacttttgtactcaatttcatcatataattatttgcatattaacttgagggtctttttataaagtaaaacaacagaaacaacgaagagctttttgaaaatttcccttttgttgcattccttctcgaggtagcaattatattaaattcaacatttcacagtgtatggatttttttctaatgccaccactggctggttttgagatttttctcattacccttgatatttttcaatttcattttaaagtacctagttgtgggctgagatttttctttttctttcttttttgagacagggtcttgctctctttcccaggctggagtgtagtggcacaaacaacctgggcaacagagccagacttcaacctcagcctcccagctcaagcaaccctcctgcctcaggaggcaagaagctggtacctcccaagaagctggtaccactgatgtctgccatcactcctggttaattgtttgtttttgtttttgtagagacagggacttactctgttgcccaggctgctctcaaactcctggcctcaggtgatcctcctgcctccacctcccaaagtgctgggattacaggtgtgagccactgttcccaggcctgatttattttattttaaaattacatgttttgagccaggcatggtggctcatgcctgtaattccagcactttgggaggctgaggtgtgtggatcacctgtggtcaggagtttgagacaagcctgaccaacatggtgaaacatcatctctactaaaaaaaaaaaaaaaaaaaaaaaaaattagccaggtgtggtggcgcatgcctgtaatcccagctactcaggaggctgaggcaagagaattgcttgaacctaggaggcagaggttacagtgagccaggatcacgccactgcactccatcctgggcaacacagtagactctgtctcaaaatttaaaaaataaataaatacataagataaaattacatgtttgggtactgttagtgtgttttttgattgaagaactcatatccgtttttaatcttacgaatactctgctatttttttcaaatattgctcatctgctattttttccgtttatttttgtgggattactgtgaagcatatgctatatcctctccttctgtcctaagtgttttgtatgatatatccctttgtccctctgactatggttataggtgagtttcccaggaccatttttctcttttcttttttctttccaacatgtattttaggtgcaggaggtacaggtgcagatttgttacatgagtaaattatgtgttgtgggagtttggtgtacagattactttgtcacccaagtaataagcatagtacccaataggtggttttgtgatcctcactctcctctcacttgccatcctcaagtaggccctggtgtctgtggctcccttctttgtgtccatgtgtattcaatgtttcactcccggtaccacctttcgatttacaaatttgtttttaaattgtatccagttatgatcatcccatctgatgcactttttaatttatattacaattacttaatactatatgtatactttttatttctatgatttgtttatgattctttttcataagacaagaaagttgctttggttgtttttgttttaaattaatattgaattcatcttattgagcactttaaacatcttccaaaatgtttgtcaatactagagttttattgacttttataagatacattttcttcctgtgtttgaaacatttgattccagtctcatttgatgagagtatattttatatttttctccttctgtctctctccctgcttacttttcttggtgctcatatatctttgtattgctgttggcaattgcctctcgtaacccctgagcagccactttataactgggttttatacggtagtgattctggggagggcagatcccttcccagaaccagcagaagtctgtcctcaactcatgaagtccccctccatgtcctctcttctccctatacctttaggttatttagagcggctctgtccaatcaggcagccactagccattgatgaatatgtaagttgaatatttagtcaacggaattaaataaaatgtaaaatgcagttttctattcacactagccaattgtgtctaatggctaccaggaagggcagctctcatgcatcttgacagacagttctatcggatggtgtgactctagagctataatcccaggtgtcgtttctttcttgttgttgttgttttttgtttgttccagcagctggtttttttttgtttttgttttttgtttgtttgtttgtttgtttttgagatggactctttctctgtcaccaggctggagtgctgtggcgcgatcttggctcactgcaacctcggcttcctgggttcaagcgattctcctgtctcagcctcctgagtagctgggactacaagtgtgcgccaccatccccagctgatttttgtatgttagtagagacggggtttaaccatgttgaccaggatggtctggatctcttgacctcatgatccccccgcctcggcctcccaaagtgctggaaccagcggctgtttaagcttggcttgttttctttgggatggatgagccacataccatgtcccactagttgcaagcagaaagccttactttatttccctgtttcattgaatcactttcagccctctgtttcttgcaggtcctaaataaagtccaagttcccattgtctgggtccagggcttttaaatccatggtaacaaaataactcactgctttgtttttctgttccttttctggtcttcaaatcagaagctgctgttatagttttcctttatattttaaccattgtaaataattatttggacccaagagattgctgaagaattgtgcatcttggccaagaagtaaatagtccattcacttttattgcagacttatattccattatattttgaacaacctatatttatttacacatactgattttatggccattttggctgcttccaatttttacaattaataagaatgctgccattaacatcttgcacttctgcacaagtatgcaagttcctttgttggacatatagcaagaaatggagctgccagatcataggatatgtgcacactaatcattgttttatattattcttcagaattgttgcagtgtttaatcactattcctcagtatttctcaagattaagaattgatttctggctgggctcagtggctcacacatgtaatcacagcactttgggaggccaaggcaggtgaatcctctcaggtcgggagttcgagactagcctgcccaacatggtaaaaccaagtctctaccaaaattacaaaaattagccaggcgtggtggcgcatgcctgtaatcccagctacttgggaggctgaggcaggagaattgcttgaacctaggaggaggaggttgcagtgagccgagatcgcacgactgcactccagcctgggcgacaagagcaagactccatctcaaaaaaaaaaaaaaaaaaaaaaaagaatttatttctgcaaatggtggatgtagaatgctatctgattttaatttcatttattcaattattagctcatatctttttcattttttatttttattttattttattttatttttattttatgacacaaatgggtcatttgtgtttcttccttggctgtttacctgttaatggcctttgcttatgatttttttactggtttttacaagttatacattcataaaagtaaaaacattttgtttatatgatttgcaatgatctttttactgccttgggctttcttttgaacttcggtgacttttgtttagaagtgttttgtgtttttattgagaagtcaaatacattatttacttatgttgctatgtttcacaggctgctctctaattattggcctcaattgatcctcttgcctcagtctcccaagttggtgggattacagtcctgagctattttgctcagcagattgattaattgattaattaattagagacagggtctcactctgtcacccaggctagaatgtggtcaccttatcatagctcactgcagcctcaaacttctgggctcaagtgatcttcctgccttagcctcctgagtagctaggactacaagtgtgtgcaaccatgtctggctattttattttttatttttatttttttagagatggagccctgccatgttgcccaggctggtctcaaattcctggcctcaagttttcctctcacctttgcctcctaaagtgctgggagtacatgcatgagccactatgcctggccatatttattcttaaataagaatgtttctgatttgtgtgttattcaatgtattattctctagcttaaatttttaaaaatatattcctcctatgtttaagttgtgtttttcatatttaagtatgtaatatatctggatttatctgtgtgtttgtgtgtgtgtgtgtgtgtgtgtgtgtgtgtgtgagatggtgcataatttaattatttggtccatatttatgattggtggtcctatgatcctttgtgtatgggttttcctttcccctctgacttcttccaatgctacttaagtattatactaattcccacatatgacgatttgatttcctctgttctctactattggtctgtttatcatatgatcaattttacaccatctttactgccattctttatgtcttatagggaaaatcctcttggatccccattgtgtatgtctgtaaagttttatttactttcacagcactctcatacttttgtattctaacttgtttttggatcacacacacctgcagacacatagacacacacatggaaattgcatttaatttgtaaataaatttgaaataaatgacattttacaatgcttttctttctattcaagaaaatgatatgcctccatatttctccatttatagaaatcttcttttagagctccttcatgaaattttataattctctccaaaagaatcctttgcaccattagttagtttcatttcacagtagttgtaactttggttgccattttgaatgggatttttaaaaaatattttcttctaaatatatgttattggaatagaggaaaaatagggattttatatattctataaagcaagattaataaagttcactattaaagagttttttaaaagattatactaaggttaaaaaataacaaaccatatctttcattattctgctggctaaaaatcaccaattaactgtctaattgaagtattgggagcagtatccttgatttgtttccgacgtgaaagggaaagcttgaaatattttcacattatgtaatagttacatagggctgtgaatctcaaaccttcgggtgcatcagaaacacgtggagggcttggttagcaaaaggttatgattctccatggccaacgcttccgaaggagtaaatctgagctgggtgcagataatttgtattccataacaagttctcaggagacgctgctgctggggatcagaaaagaaatgtggtgaagtgggcagagaggctggatgctcgcaatgggagtcagatggcaaagttaaagatgctggtcagggcagggctcactggagcctaagttgtcacctgagcaaggtcttgaggacatgagagcattaggcatgaagattcctggaggaggagcttcttaggcacgtggaacatgagaatattactgatgtgtctgagaaacttcaagagggccatagtggctggagtagtgtggttgataaagaattataaaagagtaatcccagcattttggaaggccaagacagacggatcagttgaggtcaggagtttatgaccaccccagccagcatgatgaaacttcatttctactaaaaatacaaaaattagccaggcatggtggcagatgcctataatcctagctactcgggaggctgaggcaggagaatcacttgaatcggggaggtggaggttgcagtgagccaagatcgtgccactgcattccagcctgggtgacagaatgagacttcatctcaaaaaaaaaaaaaaaaaaaaaaaaaaaatcataaaagacaggcaagagggctaatgggaggccaggaggactaccttaaaggatcatcgtaagcactctgtcttccattttaaatgacttggggatttgctctcaagagtaagataatttgatatgtttttaaaggatcatctgacttttaagagtaagcattaaagggccaggatagaaacatggagaccaagaaaggggttgttgcagtaatacagacaagatttgttgtcatggtggggagaagtgatcagatttcagtatggttaaaggtagaccttgaacttgactctcctaccattggataagggatgtgaaataaagaaaggagtcatggatgcttttggcctgagcaactcaaaaaagattgaaccccttcaaggaaactgagggtttcccttaaatgaggacactgcgtaaagaaaggaaactgttctcctaatgcactgggtgtggaaagtgctgaggatattccaaataatacaaatacagaggatttatcaagtgcatacatgggacttggtattttttatgaaagatttatttaaggactagggaccactgtggacctccttgtgaaaaacataaattgtattttgatatcgtctaatgttaaacccaagtttcttcacaatgctacctctctccctcaattatggaaacctatatgaccacactgaagtttgccatggattcaatttgtttattattctacctcttgattcttgctgccacaaaacagtagtcatttcaactctcatcattttttcctgaagatgtggatggatgccctgctgtcccagagacagacctgaaggagccgccatggttgtcatggtatgctgaatgtacaccatagggctcagtttccctgaggaattaaagtcattccatagtaatatgtatcacctttaacttatgataacaatccagtccagttaatttcatttactttttcattgacagttaaaatgatatgtattactatgtacaatctgatgttttgacatatacatgcaatatgctgtgactaaatctacataattaacatatgtatttcttcatgtagttatcatgttggtgctgagaacactttatatccactctcttaggatttatcaagaatacaatatattaactatactcaccatgttaaaaaaaaatgtggatggatgctccctcaacaaactgaactttcctttccacagtaagatgcctgctgtgagcagctgcagaaagcagctctgtttcagcaacaaagaaaagcatattgcagaactacccatacctcatgcttccgtgtcattttcctttgcatttatttttattattcctcaaaaaacagaaacaatgttttctgcttctgatgatcaaatatttatcttctataaacttgtactttatgcttttcagtttaactacaattacctttggttttccctgggtataaaatggatgataccttaatttaaaaatgaagttttcacacaagataagaaaattgcaaattctaaataaggattgatgtctgttgctaatagtctaacaagaaaaacatagtggtatatcagaggaaatatttttttaattagcaatgtatatagttctcatttaatgactaacttttaactatgtttgaatgaatttttccttgcccacctcatcagtggcacaccgccatgacacagagaaaagtccacatctattgattattaaaaagaaggtagtgaaaaatctattaactatgttttatattatttctgtgtattcttaaacacaaaaatgaaaaataaaaatcactccttttactacaaatgcttaatctttattttctaaataataaataggctagagatgttcatttcctatttccacccaccatcatcagcactatttagtttttaaatagactaaattttttttagtcaatctcaagaaaaaaagagtttaaagtcttgggtgtggctgggcgtggtggctcatacctgtaatcccagcaatttgggagactgcagtaggtggatcgcttgaggccaggagttcgagaccagcctgagcaacatggcaaaaccccatcgctaccaaaaaatacaaaacaattagccagctgtgatggcacacgcctgtagtcccaaccgctttggaggctgaggcacgtgagtcccttgaacccggaggcagaggttgcagtgagctgagatctcgccactgcactccaacctgggtgacaaagtcttggatgtgaatctcaactactttcagtggtgtctctgacaagttgtcatccctcctctgctggagtcctacagtgacagcaattgcactttattctagaacggtacattttattttgtggtttctatgattttcaaatacatatttacattctttgaacatcagtttctttaataaataggaaccaaaatgaaaatgttatagtgatgagacataaggtaatatatataaaatgtgtatcagtgctatcaggattgcaaatattctgtaaatattagttattattttaaacgaatttgtgtcaaatctttgccttgaagtgatacagtgtcactggaaggttaagatatgaacatactttgttagttcaaagtatcatagaccagtgtcttataaacaacagatttttttctcacagttctggaggctggaggttgaatttcaggtcaccatcatggttgtacctgttgaggggcctcctccaggctgcagactaccaacttctccttgtatcctcacatggcaaaaagacagggggctagctctctagcctcttcttataagtggataaatcacatttatgagggccctgtcctggtgacctaattgccttccaaaggccacacctccaaataccatcacactgaaaaatagagtttcaacatataaactttggaagaagacaaacattcattccataatacacacagaaaatgaacttgagattattttgatataaatgcgattctgtagaaataattttaaaaacccgagtgattgacagaataattaattatatagaaaacaacgacacgaagacctaaaggtatgtagagaatattttcagttttaatattcaggtaagttttttaattgggttgggttaagcatatacatatgtatacacacgtataacatacacatatctcatctatatagacacttccccgtgaacctagttgttttgcccccacacccaatccccacccactcacatatctaaatgtatctctgaatgcagatctgttaaggcaggtgggaaccttagagtgaatatagatcacttgtagccttctccacaaagcattagcactgagactcagcgtgcacacatttctacatggcaggtggccccatcgaggtcctgttaaaaagggtgcagatatagaggatgtacggtgccctgctgataagaactaaacagtgacccctgataaattaacgtttctttgtccaaaccaaaatgaggccctgactcatttcaggagaggcacttataattattgaggaaaggtgttaggaagaaatcacaggccctagagactctcaacaatctgtatcaataaagtctaataacatcataggaagcaaattaaggtggaaactgattgctgctgattgcaaaggtctttatacataatttaaatgatccataaagagcaactggtggactagtctccaaaataaattatcctgtaacaggaaattcaaatgttttgatcactagaatacaaatgataaaattacataatatgaaaacataattttaatatacattttactgaggaaagtggtttctatttaatcagtgaaaataagtttattaatatggaattgtatagtctttcattggaactagttatttactagttcttttattggttaatgtgagctaaacatcaaaccaaattctgtaccacttattcccaaagacaccgaatgatagagtggcagtaatcaaaataaagaaaaaaatacaataccttaaagatgtaggtgcattgaaattaagtaagctttacatctagaaacaattttggtctatctgaggcttgattctgagccctgagcttgtattatataaataattttttatagtgaaaagtgatcatgactttggaatactatgtaagcaatgttttgggcattatctgtttctctagtgggtccatccatccaggttcattggtttgcagaaaatatataaaatgaagcattggaaaagctttttttttttttttttttttttttttgagatggagtcttgctgtgtcgcccaggctagagtgcagtggcttgatcttggctcactgcaagctctgcctcccaggttcacgccatcctcctgcctcagcctcccaagtagctgggactacaggcacccgccaccacgcttggttaattttttgtatttttagtagagacagggtttcaccacgttagtagtagatcggggtcttgatctcctgacctcgtgatccgcctgcctcgacctcccaaagtgctgggattacaggcgtgagccaccacctgtggccggaaaagctttcacataatctccaagcacagcaggttttaagtaatctgagtgtacaggaatctctcaaccaaggggttcttgggcttctactgtaacactcccagtggcagagaccattgtgtttctgtatggttctattgaaaagtctttttttttttttaatagtgagccaatgtctctgtccttccatttccactcacctgtatgtcaaagcctcacaaaacaagcccaaactcagtgtcccaagacagctatcagctgtgggataataaccaccacaccctcttcccgaaaaggagactgactccagttattctattcactaacatattcctctgagtaattcattttcaatgtctctgttaaaggaagacatttaaaaaaataaaaataaagaggacgagatccacatatactagtctgctagctcctatctggtacacccactggctttaccctaatttcttcaactcaaatatctccctttctcccttcagcctaggagtgagatggtttcattctgttgtcaactcctgttttactttatcatcccttgcttagcttctgactctttcttcacctgtgcaatcaattgtctttattaaaagatacttgaagaggtttctgttgtggtttccgtataccaagaacacgatgatcatatttgtgattctgattacctattctttgaggttcaatgtctacttcttgtttaaagcaactgttagtattgacattaaaagttctactatataaattgacatctgtggacaaaagaaaagtgatttaaaagtttttcaatttttgacaatgaaaactcatggtcaaaaaggcctagacacaagtcacaactgcaaaccttatttgctttgcaacttgctcaaattattccaaatctccattttccatatttaaaataacaaaacaatgctgacttaacaacacagggtggaatatgtaggtaattatgtcaagtgtctagcacagaatctggaaaattgtaggcacttgataaacatgacttctgccgtttctacataaaatgatgtagattaattccaagagccccagtcacttcttatttacttctgacaaatgatttttttctaaagtactaattataaaattgactaatgatgttgtagcctagggaagttttagagtaggtcattaaagttgtaattgtagtgcaaatttttttagatcgaggtctggtaataaatcccccagaaacctttatataatgtagctttctttatttaaaaccaaggcacagaatgaaaaaactagagctttgtatcttcaaaaacgtttatgagctttataagtaatgagtaggcatggctctcttttgtgcaccagaccagggccattagaggaaatgagtgcccagaggggataaatcactctccccaaagtgcagtgaggaagtagtgaatgggagtgtgtatacctgtgcacatgcagttgtgtgagagtgagagtgtttgtggtggaggtgtgtgtattggaagtaatagtgtagattccaaaagaagatggatgcagaggtttgctattctagttttgataaatttaagacctctattatgtggaatgattaggggaaaaaccttttgctgttagtgttacaaaaacatgcatgagtgtttatgttctatagataaagatacataccttaatgtatgctatatagaatatatggtcaagccagctgatctgtaaacctgtgtgctcttagatccatgtcctggcccttcttctattctgttccctatttcagagcaccacatttcttaggctctcttgaccaacggctttgaggggagttggccagtaggaagcactaaatgtgaaggctctctatctttctgttttgtctgtttttctggttcacttccaacagcagctaggttcatctagggtttcagctcctgtctgatagacccattggttttactttagtctctgtgactcagacgtctccctttctcccttcagcctagggatgagaatggcttcatgctgttgccagtccctgttactttatcatcccctgcttagcttcttgccacttcttcagctgtgtagtcaattgcctttattaaattttctcatttcagatacttaaagaggtttctgttttctgggtataccaactcttgctttctcagtatatttaatattgagtgagcatatgaattgagagattaggatattagtacatattaaatctaaatctatattaaatatcactgtaattttcctttagacattttcagattgacttaactgtgccattaagtgactgtgggaaatcattaaactcgtggtcttactttaacctttatctgtacaataagtctaaaatgataggcttgacttacctcaaaagatagttaaggctgggcacagtggctcatgcctgtaatcctagcacttcgggaggccgaggtgggctgatcacctgaggtcaggggttcaagaccagcctggccaacatggcaaaaccccatctctactaaaaatacaaaaattagttgggtgtggtggcgcattcctgtaatctcagctacttgggaggctgaggcaggagaatcccttgaacccgggaggcagaggttgcagtgagctgagattgcgccactgcactccagcctgggtgactggtctcaaaaaaaaaacaaaactaacaaattaataataaaatggagcacttgagaaatatgcataacactgtgtaagtgctcaagagcaacaagagaaagagaaataaacataagtctccattgttggtttaatgttgaaatcaaatctaagctttaacatatgcttttcatgtgccctagaacaccgaggttgattcaacttcaatctctaaacctacaaaatagtggtaacaacatctccttctcaacagtgtcatgagggttactttacctaacctttgtaatgctctcagcacatggggattgcatagaatgggtcttcaaggaggttggttctttcttcatctattcctcagcaagatgtagaagttctttctgatagcactccctggtcaatttattcctaagtaaaacacatatataggagtattttatacatatatatatatatatatatatatatatatatcacccatcacttgattaactgaatctctctctctcttttagcagaaactaatcaccatgtatttattgagttcaagtcactgctcatctctgagattccatttcaacttgtcaaacactccagttaaatagtattcctctgaatttcactttgaatttactgtatatggatatctatttaatttttgccaacttacttgttccaggttgcattttgcttttttatttttatttatttgtttttgtttgtttgtttatttattttgaaacagagtttcacccttttttttttttttttttttttttttgagatggagtctccctctgtcacccaggctggagtgcagtagcgtgatctccgctcactgcaagctccacctcccaggttcacgccattcgtctgcctcagcctcccgagtagctgggactacaggtgccctccaccatgcccggctaattttttgtattttttttttttagtagaggcggtgtttcactatggtagccaggattgtctcgatcttctgacctcgtgatccgcctgcttcggcctcccaaaatgctgggattacaggcgtgagccaccgcgcccggccttgaaacagagtttcactcttgtcgcccaggctggagtgcaatggcacgatcttggctcactgcaacctccacctcccgggttctgtcaattctcctgcctcagcctttcgagtagctaggattacaggcaccctccgccacacctggctaatttttgtatttttagcagaggcgtggtttcacggtgttggtcaggctcgtctggaactcctgacctcaggtgatctgcccatctcagcctcccaaaatgctgggattacaggcgtgagctaccacacccagttcttatttgttttaataaaaggtcaacaattttatgcatatcactatttgagagaatatcccctacgttgccttctgtagcttacctatccttacacatgtgtttgtgtaatttgcccagtttccacatgacattcagatttagaatggtatgtctcattatgcaatcttgcccaagctagtgactttgatattgccacctctttttgaccttgctttgttacaagaaaaaaaaaaaaaaaatgggaggggacatgttacccaaactctagccagttgaattgtgctgactgctttccaaaagaacatatgttctcactggaaagattcagaaaaatttggcatcagggatggcatgtggaatttaggaataagtctttgctttttaagaggaagtatgaaatagaagaaagtacattgaatttagaaacagaacatgtggggcctggttgttgttcgaccccttatgccctttgatgtcttaggtaagtccctcatctttgttgaaacatgctctttattatttcttctatctccacaattccatggtattagaaaatgtttatatttgagacaaaacctgcacttgcatctatctgctttaatttgaatattatatttttgtgtctaagatacgctataatattgagcgattcttggtattgaaaatcaaaggaagatgagacattataaatgggtcatagtcaacaaagcaaagaatgtgcaacatttattaaaactatttgatccatcttatattgcatcatcattaagtgtattttttagttttaaaaatgcaaaaaaatatagatgtggtcataatgaaaagcaatcagttatggacctatttttctgctccaagcccccacccctaatctcctcattcacaccctgagctcaacacacacaggatagcttattaaatcacttcacttggggtttttctggttgttaatttcacatatataaatagcacactaagcctctatttcttgctttatctactttagatatggagcattgattttctactgataatgagaatgaaagtcatttactccgcaccccacttcttctgtctcctccctgactttatcattattctcagtttccaaagttggtcttcatgacacacctaattgaggataatagtatagttaagaaacagggcttactgtggaaagcagtttggagatttctcaaaggacttaaaactactgttcaacccacccgtcccactactagtatatatatatatttaagagaaaataaattgttctaccaaaagacccatgcacttgcatgtttatcacagcactattcacaacagcaaagacgtggaatcaacctaggtgctgatcaacagtggattggataagaaaaatgaggtaatatacatcatggaatactacacagccataaaaagaataaaattacatctttcacaaaacatggatgcagctagaggccattatcctaagcaaattagtataaaaacagaaaaacaaatattgcatgctctcacccatgaaaactgaacaatgggtttacatggacataaaaatggcaacaatagacactggggactactggagaggggaaggatggagaggggcaagggttgaaaaactaactattggatactatgcttcgtacctgggtaatggggtcgattgaaccccagaatctcagcatcatgcaaaatacccatgttacaaacgtgcatatgtacaccctgaatctaaaataaaagtttaaattatgagaaaacaaacagaaaatatatttgaaaaatatttgtatcattaacgtaaattcatgttgaaatgataaaacattttgccaataaaagtaattttaacttggaaaaaaaaatagaatgatagtctataaatgtgtgataattcctgaagcctttggaaaatacgataaattttaaaaataagatttaatgatttgtctttaaaaacataaatagtccaggcgtggtggctcacgcctgtaatcccagcactttgggaggccgaggtgggcagatcacttcaggtcaggagttcgagaccaaactggccaacatggtgaaaccccatctctaccaaaaatacaaaaattagccaggcatggtggcacacacctgtaatcccagctacttgggaggttgagacaggagaatcacttgaacctgggaggtggaggttgcagagagctgagatcacgccactgcactccagcctgggcgacagagcgagactccatctcaaaaaaaagtaaataaataaaaaaaatttaaaaaataaaagcataaatgaatgaattgatgaataagtaaatagcttagcttcagaaaaaaaaagaaaaaaaaacaagaaacaggaatttttgtataaaattaagattgctctagttatataattccctggttttcccccaacaaattttcaaacttacaataacaattatatttgactgagtgccaatttaaacctataggcctatgctactttttttttttttaagaccagacctccctttcatctcagtctgaggtacatgaggcttttaatatgaaatcactttccattcggtccaaagcttccttgttgctgatgaatgtcatacataatgaaagattatatccatttatcctcagcagtaaatcatttatcacacaagggggatatattattgtgaattctgatcaaagctgcccacttcctttagccggcagaaatgctgcaccctgttagttgattgtacaatatcctgggagaaatagggaaaattatgctgttgaatgagggtttggcaactctaggggtttctaaaatgccttgtagaaaaatcatgtttcatgtagaaccttctatgattcaggcatgtgagctgtaaaagtcttattttgccttcttcgcttaattaaatcagaaggctgtgggacttttttcagcttgctctgtgatgtctgcaaacagattcctgaatgacatcctgtggacactttgcccccttttttagagagacaataattattaccacttctttttgaagcatgctgagtggttttatcagttgtttgctaatgagctctgtctctcctttataatgtcaatcataaggatgccttttaaatacaacttatctcccagatttattttcttttcattcttcctgatcaaggtacgtactgttttgcttcagggaatcatctacacaacccaggcagagaaggctggcctctttgatctcttgtggataacacactctctccttctgagaacagagctttccaaaaaggacattaccaccctccagatgagtctcttcttgtgttttatctgtgattttaggttatcattgccctctgttacacgtctgtattcactgcttttcaaattcaatagcatgtaagagtctcagtattaaaattatcctgagtcaagtgagatacagaatgaagcaggaacaataggtcttttcttccttccttctctcttgggcttctggccagcatgctggtatggtttgttcagattttatgcaaagctttacctggcgattcaccaaatcaagtcagaaacctgcacctaacatttataaacaacatttcttcatttgatcatcaccttattcttgaagtagctttcagtgctttggctatttaagaagtcagtattgaaattcatattctacccttgcacactgtgtgagctcactatatcccttgtgtggtgtatagaggaagtataattttccccaagtgccttatccttaaaacaagagatagctaaattgatcagaacgggatatcgttataggaaaaattgtatacattaaactttaggtgtttctgttaatagttcctactactgtgactattcagattattgtattccaacataggtaaaattgatggatttagcaaataaaatacagtacacctgttcacatctgaatttcagataaacaatgaatgcatttttagtataagtatgtcccaaatattgcttctaggacacatacaagaaattgttgtttatctgaaattcagatttgaacaggtgtactgtattttacctggcaacactacatatagtagaattcacgttctagtctttgctagtctgtagatattacgttcccctacttggtaactcctgtgaactgaattgtactgcccctacactgctattcacacggtgaagccctaactcccaatgagactgtatttggagataggatctttaggggaaaattaaggttaaatgaggtcacaaggatggggccttaatcctgtagcactgtgggcttataaaaagagagaatctctcttaggtgaggactcagcaagaaggtggggtctgcaacccaaggagagagccctcatcaaaacccaataatgctgcacctgaatcttggactcctagtctccagaaatttgggaaaataaatatctgttgcctaagccacctggtctatggtattttgttacagcagcccaacctgatttatacagtaactttaggatgtcttactagggcacagttttatgtttcttgctgaactgagatctagcaagcatagtcattaccttagatatggtatggctgtgtccccacccaaatcttatcttgaattataacttccataattcccatgtcatgggagggacccagtgggaggtaattgaatcatgggggcgagtctttcccgtgcggttctcatggtaatgaatgggtctcacaagatctgatggttttataaatgggagttgccctgccctgcacaagctctctttttgcctgctgccattcatgtaagatgtgacttgctcctccttgccttctgccatgattgggagcctccccagccatgtggaactgtaagtccattaaacctcttttgtaaattgcccagtctcgggtatgtctttatcagcagagtgaaaatggactaatacattaaatttgttaccagtagagcgggaccctgctgaaaagataactgaaaatttggaaataactttggaactgggtaacaagcagaggttggaacagtttggagggctcagaactagaaaggaaaacacaggaaagtttggaacttcctagagacttgttgaatggctttgacaaaaatgctgatagtgatatgaacaataagttccaggctgaggtggtctcagatgaagatgagaaacttgttgggaactagagcaaagctgcctcttgttatgttttacaaagagactggtggcatttttccccttccctagatatttgtgcaactttgaacttgagagagataatgtagggtatctggtggaagaaatttccaagcagcaaagcattcaagaggtgacttgggtgctgttaaaggcattcagttttataagggaagcagagcataaaagttcagaaaatttgcagcctgacaatgtgatagaaaagaaaattcaattttctgaggagaaattcaagctggctgcagaaatttgcataagtaacaaggagccgaatgttaatccccaagacaatggggaaaatgtctccaaggtatgtcggagatcttcacggcagcccctcccatcacaggcctggaggcctaggagaaaaaaaaatggttttgtgggccaggcctagggcccctctgctatgtgcagtctagggacttggtgccctgcatcccagctgctccagccatgactaaaaggggccaaggtacagctcaggccatggcttcagagggtgcaagcaccaagccttggcttccatgtggtgttgagcctgcaggtacacaaaagtcaagaattgaggtttggaaacctctgcctagatttcagaggatgtatgcaaatgcctggatgtctgggcagaagtttgctgcaggggcaggatgctcatggagaacctctgctagggcagtgcagaagggaaatgtggggttgaggccttcacacagagtccctactggggcactgtctagtggagctgtgagaagagagccactgtcctccagaccccagaatggtagatccaccaattgcttgcactgtgcacctgaaaaagctgcagacactcaatggcagcccaagaaaacagctgggagggatgctgtactctgcaaaaccacagagatggagctgcccaagaccataggaacccacctctcacatcattgtgacccagatgagagacatggtgtcaaaggagatcattttggagctttaagatttgactgccctgctggattttggacttgcatgggacctgtagccccttcattttggccaatttctcccatttgaaacaactgtatttacccaatgcctgtgcccccagtgtatctaggaagtaactaatttggttttgattttacaggctcataggcagaaggtacttgcctcgtctcagatgagacgttggactgtggacttttgagttaatgctgaaatgagttaagactttgggggactgtagggaacgcatgatttgttttggttttgaaatgtgaggtcatgagatttcagagaggtcggggtggaataatatggtttggctgtgtccccacccaaatcccatcttgaattgtaactcctgcaattcccacatgtcatgggagggagccaatgggaggtaattgaatcgtggggtctggtctttcctatgctgttctcatgatactaaatgggtctcacaagatccgatggtttaaaaatgggagttgccctgcacaagctctctttttacctgctaccatccatgtaagatgcgacttgttcctccttgccttctgccatgattgtgagatctcctcagccatgtggaactgtaagtccattaaacctctttcttttgtaaatttcccagtcttgggtatgtctttatcagcagggtgaaaacagactaatacaacctttctagtctggacatgttagtcaattactcttctgattctgagcaagtagagacaactgaaggaatctcccaatggttgtcccttaaacgtcaaattctatgattggctaatttctcaattttgatcatatcataaatcagaacaataaagagaaatcatggggggtagatgtgacaatgaacccagcctactattggctgaaaaatattaaaggcactgatgggaacatttaattgagtagacaaatgggggagatagcctgactgtcctctgactttgctgttagcatctaaatctacctaaattattggatgtatttacaaggaataagggcagtgtttgtttgtgtgtgtgtgtgagggtgtgagtgtgtgtaaaggtacacagagcatgtactaaatcaagattcagtaaccccatttagaaaggagcacctgagacttctgagaggttaatcacaggcctccatcacccttctaagtggcagaattggagaccatcctgcagccaaagacatgccttttcctccataactgactacctacattgaaaactagaatctcacatttttcacaatagatcttttgtatactaagaaatcagtaacagtgcatttcctcaaattgacatgaagcaaaatttcatccatcttccaacaacctgtcattgttaccccctctaaaccttttcttcttcataagggcaattattattttattacctctggtatgatattaaaattatgaagactttcctccaaggggccaccatattactgtctcatttacattcttatactaaaaatagatttttttttataccagatgtggtaaaatcaaagctaagttagacagaatgggtgattcctcccacatagctgctctggagaacatcgctatgcaccctgaagtgtacagggtgttcatgcccatgttaggtattttagttttgttaatgaggtggtgaggttgaggtgaagctcatgactaagtagaggcagaaatctctataaagaccaaatgtttattcagactgatgtgagaactctttagcttctgattctccaagaacaaatgtgtcataattagaagtaaaaaattgatgtgaatgggttgctgtttcccaggtactaaaagtgaccaatgaagtgtacggctagctgctggacacaagtccctgatactcaaggcctggttgagaagaccttgtagttgagcaaactcatttgttattatattttttaactcatcaaacttgaacttgttctttttcttttccttttttgtggctcaaatagtgatgcatgcagcacaacacctggatttgggcaaatgattttaaattcacacgtaaaaaccatagcaattttatgatgaattggcctccatctacttctgaatttaaactttgctaaagggaaaatccctacattttcttttctttttttttttcctttttttttttttttgagacggagtctcgctctgtcacccaggctggagcgcagggggtcgatctcggccaatgcaagctctgcctcccaggttccagccattctcctgcctcagcctcccaggtagctgagactacaggtgcccaccaccgtgcctggctaattttttgtatttttagtagagacagggtttaactgtgttagccaggatggtctcgatctcctgaccttgtgatccacccgcctcagcctcccaaagttctgggattacaggtgtgagctaccgtgcctggccaatccctacattttcttaaaatttaagatataattccattagcaagaaacgtcagagtgacattttaagcaatgcttgcatcagacaaaaaatgtatgatgtatttgaaatctattgacaacacattggaaaaccttcaagagttctaaagcagccgttactctgaaatttaaaataatcccattttagattctttcaattatagttaagaggattttgtaaaggctgtacctgtagccagtctgtaggtaattttaataacaagtggttaacttaaagatcttcctgtgttaattagtgttcttttttaaataagaattattaattaaattctcaattcagcaaaagaaaccttattctttaatcaatgtcacaaaattctccatagtcaaacttagatctcagtttccgtgatgagtggctggggaaaggaatgcgttctcccaccattaataccttttgagccaataactctaggctgtagatccttagctagaaacgtttttgtccacccagaacacactttgcatttagactgaggcctcctttgaaattctggctcctacatttcctatctccttgacactgggcaattcagttttccttgctgagaatccatcctctgttttttgtttgttcattttggttttggttttggcttttaaatcgagggtagtctgcagtcaagaaatatcactggaagctgggtgcggtggctcacgtctgtaatcccagcactttgggaggctgaggcaggcggataacttgaggtcaggagttccagactagcctggccaacatggtgaaaccccatctctactaaaaatacaaaacttagccaggcatggtggcacatgcatgtagtcccagctactggggaggctgaggcaggagaattgcttgagcctgggaggtggaggttacagtgagccgagatcatgccactgcactccagcctgggttacagagagatactctgtctcaaaaaaaaaaaaaaaaaaaagaaaatgtcattagtctttgaccaatatttatccagtccttatccagccccagttcctagtaatcaccattctactctctgcttcagtgagttcaacttttttagattccacgtatacgtgataacgtggtatttgtctttctgtgcctggcttatttcacttaacataatgccttccagtttcattcatgttgtcacaaatgacagaatttcctttttttctctaaagctgaatagtattccattgtgtatatgtagataccatattttatttatctattcatctgttgatgaatgtttaggttgattccatttctgggctattgtgaatagtgttgatataagcgtaggaatgtaaatatctcttccacatactaattttatttcctttgtctatatatccagtagtgggactgcttaatcatatggtacttctattttaaattttctgaagaatcaccattctatgttccataatggctttactaatgacattcccaccagcagtgcacaggaggaataatttcaagaaatctactgcataatatagttatgactatagttaataacaatgtactatatacctaaaaaattgctaacagtagacattaagtgttctcaccacaaataacataaggtacaatataggttaatagcttgatttagccattccacattgaatacatatttcaaaacatcatgttttaaaacattaaaacatcatgttgtacattataaatatatataatttttatgtcataaaaaaagaaatgtcattatcattctttagtgacaattcacctgaagtcttcttacccatagttgatgagtgtcttttaaattataaagctcaggaagtatgcctttaaatcactaaccaatatctgtgatatggtttgcttaagaacatttttagattggagaataatttacaaatctaggtctttcatttttaaaataaatcatggtgttagttcatgatatttgggccatatttttaaatcctaatcctgggaaaggtggttaggtatatggcaatttatgtctccactgaatttccatacagaatgccagaaggtaccacagataaagcaagagctttaaggtcaatcacagctgagtttgtatgtagttcaagtacttactggctgtgtggttttggggtaatatacttaacctttctcaatctctgtttcttcagttgaaaagctgggattatgctttcaaattcaaataataataaaaactaacatttcttgaatgcttatcatgcaccacaggtattgtatcatttactcctaataataaatccagggggtggctactgttatctgcattttacaaataaagaaaggaggcacaaaaaggcagagcagccaggcttcaaaaccaggcagagctccagaccaccttgcctctcaaatgtaaacttgaaatgccagacgatctttccattttccccaaccaaggactgacactgaggctgaggagaattggcagaagagagagaagaatatctggagggtttgttcctttttcaaatcagcatttaatagccctgttaaattggcaggcgtgtatattactgaccatgtttctattttcctgtaacaccaaagagtaaaggccattttttttccctatgaataaaagttgtcacggtcaggaaataaaccatatagtttgtctacaaccatttcccttgtgaagctaattgattttggctagttaaaactttatgtctaaaatcaaggtccaaagaagaaagtatgtataccttctatagcatttataaagagaccaggcactatgcaggaattggagcaaacatttgaacatatttgtattcttcatatatttgtctctataaattatataaaatccatttttgtagatacagagtataagattcctaggcataaaaatgactaaaatgcaattgtatataatatcagctacctgcacttgtttttctccttcctaataccatctcatttttttggggggttgaaactgagaaacaaagatattaaataattttcctaaaatatacccatacaactaaatgggaaagccataatataaaccatccctcttaatcatcatgatattaataaggaagacaggtgctaagcaaccatatgttgactgggctatctatgtagataatcaagtccctgagaatgaggacagagtagaattggagagtgtgacagtgaagcaacaataacacctttcatcaatgagtaaatgaccaggaaatccacagatgtggagcaagagagtagcacagttctctcaatagaaccatgttagtgttgcttgtttttgtatctgtcttgttttgttttcctaacaagaggaagaaggagaaattgaagaatgatctggaaatgtaaggaggctgttgattacaactgggggttcaatttttcactcattgtcatattataagccgtaacttagttgttattcaggaaataggctgaaagacactggcagatgagaattgcagagatgggaatgctctgaagttagcagtgtggccaggtggccaggataatcacttttagctggccaaaagatgatcatttctgtgggaacatcagcaagtgagtgacctgaccattttaagtctcttccttagggtcctccacatccagcctgggtaatatgttgctcaatctgctttaccacaccaggcaaaacaagtattgaatttcaaccaatgatcacagatcttgtattgtctcatccttgctggtactgttcgcttttctctggctcaattgttgccttttaaaactctttacttaaaccagccactgggcttttccttggggacaatgtagaagaggaaaacaatgatagaagggggtgctttttatttcaggtacagctgggcaggtgggatggatcagggaaaagctccaaggatgtcaagagtagaaatagtgatgtctacctttgaaactacaaaactccctacacaaccaagtgattggagctttgaaagcaatgcggagtagaaaactaatagaatatcaacctagttaaggcaagatttgctgtggggaagggaaggtcctgagcctctatttggccctgaggcttatcaacctgatacttcagttgggctcagaaagactcctgccccctccccattccctccctcccattgtgagggaccaatctctcttattctgtgttttcttaccatctcttccaccacttacctgctctactctgctttgcacatggtctcctcaactatgcccttccctacagccttttaaatgtggaaaagaaacaaaacaaataacatgatcaagaacttaccggtttccaggccaagtgcagtggctcacacctgtaaacccaaacactttgggaggccaagacaggaggattgcttgaggccaggaatttgagaccaacttcggcaacctagcaaaacccccctctacaaaaaattaaaaaaaataactgagtatggtggtgcacaattgtagtttcagctactcaggaggctgaggctgtaggattccttgagtctaggaggtcaaggctgcagctagccactgcatgccagcctggacaacagagtaagactctgcctcaaaaaaaaaaagaaaaaaaaaagaagggaagggaagaaggaaggagggaggaaggaagaaagaaagaaagaaattcactggtttccaatgtaacaaatcctttatctcaaagtagatgtacacttagagttggagacttttttaaaaacaattacaatgtctcggctcttgtgaactgagtttgctgtatggttatgtcactgtggataatgattttctcatttttttacacaatgtttatcaactttggctgtgcttcctctcctgagcatgctccttgttttgtaaaacaactggggaacattgagatttttcatataatttctgtgatgccaggctcctaagggataaagaaatacaaagaacagtgactggacagattgagtggagctttgaaagcaatacagagtagaaagataatagaatatctactataatgacacatgcacaagtgtttttattgcaacactatttgcaatagcaaagactaggaaccaaccaaaatgcctatcaatgatagactggataaagaaaatgtggcccatatacaccatggaatactatgcagccataaaaaagaataagttcgtgtcctttgcagggacatggatgaagctagaatccatcattctcagtaagctatcacagaaacagaaaaccaaacaccacattatcactcataagtgggagttgaacaatgaaagcacatggacacagggaggggaacatcacacaccggggcctgtcagggggtgggtggctaggggagggatagcattagtacaaatacctaatgcatgtgaggtttaaaacctggatgtcgggttggtgggtgcagcaaaccaccatggcacatgtatacctatgtaacaaacctgcacattttgcacatgtatcccagaacttaaaataataaaaaaaagaaagataatagaatattaacctggttaaggcaagatttgtgttttttaaaacatatattccccattaaagactacacatgtacttcttaatgttattaactttgtcatgtattaagatgaacagaaaggcatttctattatatgaattttttcttattcttgtgtctttcaaaaagaaaaaagaaaataaaacaaacaaatacacactcaactctcccccaaaaaaccaaaacaaaaacaagcaatgcaataatatttctcaaaagatatgcttgacacactatcagaagttctgccaacttcaatctatgcactagaagtgcattgaaaacttttattctttgcttcttgtctttaatattgttgtaaattcaatccacttcactggcattacctgctagcaacattccatcttcacatttggatgagtgtgaacttatcaaggtgacatatgtgtgatttttaatggaaattttactttgtttttcttaaaactgggtgtcaattagcagtgactcgcctccttaacaaaggaacagggtttgctgcctgcccagccacacagcccctggggggcttcctagcctgggctaggctgctgcaacatcatcacactttattagttacagcacagagttatggaggcaggaggaaagtactcactatgcaattttcctgataccccatgaggcctgagcacctcaaggtgggttagcactcatggaaaatcagtttaagatgggaaaatttcaaacatctttccttattttctttcccacacacaaatagaataatgcattttaagtaacaaagaacacttaaaaagcaaaacaaaaacaaaaagacacttatccttaaaagccaccatctccttaggatattcctcttatattaaataaggatacaaagagtaaagtgtacttaaaatctctcacaaagattggaaataaaatcttcaaaaagtgaatgcatacaatagcacatacgtaggacgtaattcattattattgggaaatgaaaatgaaagcaccatggtacgataattctgaataagaacaagctaattacattagggcagctttcagaaaacaagaatttatttttttatgacaaatatgactcagtacaaagtacacaaagtattttctgactcttactgtgatatgcctactttatttcaagtaaaatatatgaatttttaaaaggttatgaaaatgtgtttatgctttaaaaaaatcatttcagtaacatgttggatatctggaatatccatatattggaggtctgtgttctcagtctacaaggaaaattgccaaatccactctagagtgccaggcttaaaaaggtgttgaagagagcctgcccgattacctgaattccaatttggctcacaatgaaagatagaaaaattacctagatgcatttcaatgttgcttctccccttgcaatagaccttatttaatagcttattacactcagaaaacaaagcatattttaaggaaagaactcacgacgcatggttcctgtctcttgacagaacggcctctttgaattcttttgtcaatttcatagatttctaacaagcagagaattgttttttaaatctgattttttttaatgccagcagcactatttcctcctcttaagtaggacagattcatcctttaagcaacaatggatgcttccctgctgaactcgagcatgacagattaagcttcgagcagaccagtaaatgccacctccccacttaacaaggctgttcagagccaggcgtctggggcctcgccgtatttgttcctggaatcactgtctgatgagccactgctgtccgaggtggccaagcagccctgattgagcgagctatgtgaagacccgacaggggcctggcagggcggcgggggcatgcctcctttttggtgcttccaggcaaattccttgcctccaaattgtgcccgcctcaggacagttggcttgtacaatgcctggcagaaagtagacactttgcacttgtttactgaatataaaagagaaaaatagagagagaaaaaatctgagtttagagatgcctttcagaccttgccggataaaatgctgttatttctggcaaagtggtgaggtgacactgacttggaagaataactaagaggttaaaaaaaaaaaagtaggactaacagtgaacaagctaataaaacacatggaaaccaaattagtggtagccaaaatcaataatagatccattatatttcaaaatatcttttataagaaaatggcacttggaatatgtttctaaatgccttttagagaccagtgtgttgcataaagaaaaatacacctgcatccagaattataattttaagaaccattatttagattgctgtgaggtatcttaaaatgcgattcaatttgctccttagatattgcatatcaaactataaaagcaaagctacattgttggctttctccctttttggcaaagaaatagaattgagaatctgcctgttgaggtcagaaacagactgaatcaaaaaatatgaaagcatgaatgtactgttctcacatttatgtaattgatggctattttacttgttgaaatcttaagtctttcacaaccacatgcgtatgtttgtcatttatccccttttctcaggtgcaaagaaggctaccaaggagtccgttgtgatcaatttctgccgaaaactgattccatcttatcggatccaagtaggtcaagcatttttcttctctctaatgcaatatataggcagcgtttattctgagcaatggttgttaactcagctgaaagctatatttcagtcttgtgtctctgaaagctgccaaggacagaagctgatggcagatgttgatgttcaaagcatcctcagagctggctcagtctaggtcttctctgacgatgaggcctggcttccggattccaccttgaacccctgctgggaactcccaacaacccgggcctccttagctttccttctgcccagccacgtaccacctcatttcaaaagcagggatctagaaaaataacagagcttattatttacctgaaataatgttatggaaactacagtattataccgcttcttacgctttggttgttaatttatgatagtattaaaccataccttactaaagtaagaaaacgtgtacgaaatcatgtaagaagttttcaagcagactttgaaaactccatttttggcaacactatttgcatatcagtgattactgtcctaaggacaaattattttttctccattcatggaagaagacaatttgcagactaaaaaatatggctagtcattagtttgtttgtatggtagtaaaagtaaccttttatgcttaaatgcccaattctagtcaaatgtgaaatgtttatctttaaagaattctctgttctttcaatagctgctagaattgaatcatgactaaaaaatggggattttcattgaatcagcgatttagtttagtgaggataatgataggcattttgcaattggaaaggccaagttatggttttctgaatatcatacatacgtaacacagacttcagtaaatattttgtactgactaaggacagaggtcgccctgcctgtgtctgtgcgttttgctgcataatgaacgtgtctaggcatcttccaacatcttttcaaaatgcatattttcatttccccctgaatttctagctacatttactcaagtaaatgcaaagttatttgaaagaaaaaggttttgtttaatttaatttaattctattttatcttgacgaagcaattcaccatacagtaactactctttctttgcaaatttagctttccttgagaaaagtgaaggttgccacagggatatctctatttcctgaaatgtgagacacagttctctgggaattacccaaagaggatggtattactggagtttttggtatcttatttatcaagtgatttggaccacttgctcaggtggcctctgaaagggtattcatggttatgatgtgagacatatctttggcatgttaggaaacttgcataaaataatgggcttgctgatttctttctttttctttctctctcttttttcctcacttttcctaatgtatctagtttttctctttttctttctctcttttttctgtttttatcccttctcttttcctatttatttcccttcattattttgtctcctttaatataatacttcttcccttcctccctctttcccttcctccctctttccctttccccctttcctcccttcctcccttcctctcttcctttcttctttctttcctttcttccttccttcctccctccctcccttctttcctgttttgctttcttttcatatgtggctgtggaatagctattcagtacaggttacaaagggcaaggtcttgcatatggtacaaagtgggtaaaaaaaacctctttaaacaatctaatcaaatgttaccagccatttagataccatagttcatcactgcaagagtggaggagggggtcaccataatgactattctctcctcgtagaacaaaatggtcccacggttacagtcactatccctgaaaacctatttcaatgtctattaaattgctattaaaattatagctgtgtgagccaggcacggtggttcatgcctataaacccagcactttgggaggcagagatgcttgaggtcaggagtttgagaccagcctggccaacatggtgaaaccctgtctctactaaaaatacaaaaattagcctggtatggtggcaagtgcctgtagtctcagctacctctggaggctgagagaggagaatcacttgaatccaggaggcaaagttgaagtgagccaagatcacgccactgtactccagcctgggtgacagagcaagactctgtctcaaaaaaaaaaaaaaaaaaaaaaaaaattatacctctctgaaatgtttctattaagtgaaactgcaagataaaaaattacttttatataaaattgcaaaaggaacatactttgccccaaatgtagaaaagaaatacactaaaatgttgtaaggacgtggaattttatgaaattgtttttctatttctccagttttctgtaaagtggtatatcattatgtgagtcaaaatgccagaatccttgaaatttaaaaagaaagaataagcatggagagcccatggatgagtccttgagacacagcttaaatggaaaagcattatgtcttgcattcatccatgcacacgtgcatttctttaggtaatcattaattcatttcatcagtattttctcagcatccaccaagagccacctaattggtcaggctctgttaatacaaaagtgtgcaaacaggatttaggccctgaggatcccgcagattagtgagggggaaaaacatgtggatatataaacatggggatgaatttggtgtaacatttacccttttccgacgttagcagatttgattcggcttccaggcctcaggctttcacttgagcaatggcaacagtaatacctataagcattattgttatcatatagatggacagagtcaatgccagataatgtcagcccacttcccttattcctcactataattgttactaatacgcgtttaaatgatacatgtgccaggcactgtgccaaaggctttacatggattattttattaaaccctcacaatcacagtttagtaaggagactgctgacaattgcccacattttatagatgagaaaattagacctcagggaagctaagtaaacttgctcaaggtcatacagctagttaatgctagagtttaacttccattccaaatgactccaggacctgagctcccaactgaagggcgctttcctccctcccctagaaccctcccttctctagttattttcaacaggacatttatcactctaaattccactgactgaaactcaatgacctgcggcaaacattattctaaggaacaatatttgcacaattttcatatcttaatgcagcaacttgagcttccatagagatttaaatccctaatgaaatttccttgtcaaaattcttgctgaaggattgtttaatttgctgctcatgatatcttcagaatgactgtatgctcaggaaataagcttccactcaactccctccctccattttttctcttctgtctcctctcttctctccattccatcttccttccttcctccctctctctcgtctgtccagtgcatacttttgctgagtgaaatccctattagcagggggtgagaaaccgctgctcttttattctctcccaggcaatgcaaagttagtcagaaatgtgtatcttttacattaaattttaaaaataaaatcttaaatgacctatatttaggaaaatggtgcaaggatgtcactgtgagagccttactggcttgagtgtcttagcagtggttcagagctgggtcctcagactgtttcaaaaactcatcccctctgctctcttttaaatcccaagaacctatagctaactccattcaggaacatatttacctatgaggatcaatcttataaagtgtgtcagtgacagtttttgtaaatatatctaatgcaccaatctgtcagattaatcaaaccctcctatggattcaatgtaccacaagtcgcattcagatcatgaggctgaatagcaagcaggagttcagaaagaatgtagtgagtgactcagactttggtcagagtcaagaggaagtgaccttctgtggaggagccggcatcagctactgtggcattcttgaagggcatatttctgcctcctgcctcctatgctgccagcgcactgagggatagcagcagtaagcttcccggaagctgacttgtagactcctgccctggttttccttccttactacccattcccacccagggtagttaccatcctcagccttgaagcacagttagatggagctgaactatgtgtcagtcagaactgtgagccagcgaaggtttttctccatctcccctctcatgagcacatgccaggctgagttcccatcaagatcctgacataatcaccagccaatggaagcatgggggatgctgcagagaacagactcagaacagaatcaaagaatgcagtggggtagagaagatgcccattggaagcaagggcacgcctcctcacacacagctggagacagccgtttctaccccaccctgtgcctttctctccctgtcagaatccagtacttagcatattcctggctgtgatggcaggcttgagtctgcaggctcaagctctggcaagcagtgtatacagcttaaacacttggagtcgtctagcccctccgtggaaggtaggagcatcacttccatcatgtattcatacgtgctgacttcgattcgcactttgtttctttgcatcttagaaacaggctctgttctcaaagcacctggaaagatgctaggagcctggtctggatgtgattcagaggaagactggtgaaaaatatgatatggatttagacttcccatcagcccactgggtttgtgtgcctcagctttccaggaagaaccacttcacaagtccctaaagaaaagaaaaaaacaatcttcggtagagtgtgttctagcaccagagagggcatcaggtaggaaaataaatttataaacacagccccacttccaaatggcctgcagagacaaccaaatcatgcccaagcttggtctccttcctcatgttcccagggattgtcattcccagtgcctagaccatcaggctcagagccaagtggtgcccctttgccatatgtgtcacagtgaaggaaaaaaaaattgagaacagcctgggaatgccaatgtagggccaggagcctgggtaggcatttgctaagcagacacaaggagattttcctgaagattattaacagaaagttttcccccaaaagacccatgttctgtattcttgcctttctcaattgtatttaatatataggaacatgtgttctgtgtgtcaacaattaggtgaaagggtgaaacaaaaggtgctctgaattggaagtcaaagggttttgttctaattctgtgaccacctgatctttgtggtgtggcctttggcaaagcacagtttatttggaccttggtttctttatctgtagaacaattccatgggcatccagcttaaagaaagtgatggccctcagcagagcaggctgtcttgcaagccattcagaaggggagttcagtgcaccaccaaactagtggatttcttcactcattcattcatttccccagataattaagcatatgtaacatataccatgctttggatccaaataataataatcacagatcctattgtcttaatccatttgggatgctatgaaaaaataccattaactgggtggcttataaacaacagaaatttatttctcactattgtgaatgctaggaagtcaagatcaaggtgctggcaggttcagtgtctgctgtgggcaattttctgatagagggtgcattctctgtttccttacattggaaggcatgacacaactctctgcgcctcttttggaagggcttgaatcctattcatgaggatttcttcttcccgatctatcacctcccaaaggcactgcctcttactagcaccacattaaggattaggtttccacataagaatttcggtgggacacaaactttcagaccatagcatctaccatcagtaaactcagtgtagttaactgtgtttattgacattgaattacagactacaaaggacgtaatgtctgcaagatattgaaatgttttcttccttcactcattcaaaatcttattaatagtttgacattggacaagttgcataacattaataaaccctggctttcttctttataaattaagatattctaatctgtaacatatatagctgttgctaggatgaaataaaatactccattcagagcatgtcatgcttgggacattgtgagagctcaataaatattatctattatcatcattattatttttgttgtttcaactgtcaccttgattagtacacagtgtacaaggcactgagacaggtgctactaaggattaaaaagcatgcagcctattacctggcctcgaatatctccagttgtactgaggaagtaaaaatgcatgaagaagtacaaatgaggacacacgaaagacatgattgctaaggaaatataaaaatggaggggcaataaaagttcacataaagtggaaggagagatctggtgttaggaaaggatttctctaggagagaagattgcagtgagctattcacacaggatgtgtatctgtgaactgttgtacaagctgcacactgcccgacttcactggtatcatttatgctagagtgtgaagggccttctgtggagggttgcaacttggtcctgggaaggacatttccatgaataaattagatagaggaaaaacagattcttgaggacacaaagcagaaactaattatcactttcccctggtctattaatccatacagatgaaagaatgtatcttccagactggcatctgctgggaatacttaagtctgctaagctactctgccttccaggagccataaaaacattgttagcagaatggatttatatgtaaaatctgtcactcttattaccgtttttctggcttgccatgagaaggagaaacagagaattatctgattttgaccatgtcaccatgaatctcacaaaacccattaattctgtcaggttgtatatttttatatatttgattgctaatatcttcaagtctttccttttaaattatatagacaccaatcttttaccaatcatgtatgcaaacacatgatttctagatactaggaaaataattttatttacaagaaaggaaaaatttcctatgggtacctgattcagagataaccactgataatcaattcgtgcatactactccacatattttctactttttctgtggcatacatatgtattcatttttatttgtttgtttggtttttagaggcagggtcttgctctgtcacccaggctggagtgcaatggcatgatcttggctcactgcagcctcaactttctgggctcaagtgagcttgcctcagcctcccaagtagctgggactacaaatgcctgccaccacactcaactactttttaaaaaaatgtttataaggacagggtcttgctatgttgcccaggctggtcttgaactcctggcctcaggagatcctcccatctcagtctcccaaagtgctgggattacaggcttgagccactgtgccagacttgtatttggttttaaccattatgttgaaagcaggcctcacagggccagagggaagcccacctgcccttgcctctctcagctagagtgtttgggtctgtctgcccagcttgctaactacagcttccctgttggccccggctcactgggggccactctacccactctacccgggaagaggattgttcttctgtcctcccagggggcctgttcagcaggtctgaagacagttcccaactggttctcggttctcctgtgtggtccacagctattccacaggacatgctcactatattgtatcattgtgccctgggagagctgggcattcaggagcctctgtcaccagactgtcaggatcaaagatgacacttcctctctgtcatctctcctctgtcctttttatagtttcaaagtcagagagggagatcaagtgttatggaatggttctagattatctaattatttcctttataaattctgcgtgtggtgttttgtctcacacttcattatctattattcattatattgacatcttaatcaaatctgaggtaccagaaattaaatattcataccttattacacaatatactcatttgccttacaaaattaggattggctggatgctcacgcttgtaatctcagcactttgggaagccatggtgtaagtactccttgagcccaggagttgaatatcagcctgggcagcataggaagaccttgtttctagacaaaaaaataaaataaaatagccaggcatggcggtatgcacctgtagtcccagctacttgggaggctgaagctggaggatcgcttgagctcaggagctcgaggctgctgtgagttgtgattgcgccactgcactccagcctgggtgatgtagtgagaccttttctcaattaataacaacaacaaaaaaaggaacaccatcaggattatactacctgtattttgtaacttctacttcccactcaatatattgtgagctttttcccacagaattttcttaattttatattcttttaaactattcttttatattcttttataaatattccttataatattataagaatttaacgtaaattattttaccagtcatctatgaagggctgtttagtgggtttccaattttgcctgcttacagtgattaacaaccattatgcgtaagtctctgtaccttgatgtccaaatgatttcttgaggataaattcctagattttgatatattttgataacttttcctccagaaagattatatctgtttacatttccgtgagtgaaaagtaaaattgattttacttttttctttaccaacactggatagtattaattgctacttgtacagggaaaattatataccactaatattttatattgtaccttgattgccagcaatattgaatccttttttcacttgtttattggtcagtttcatttgtacctttatgaatttttaattatttttctttgctcactttgaaatactataatatttcaatcttatttaaaagagtttgctattttgaggataacaaactattcactatcatataatttttccagattgctctttgatttattatttatgatattttttgaagcatacaaaagttttgccttttatggagtcaaatctattaggtattttttaaaaagtagttcatatgggctaatgctatccttagcctaagaatgaaatgaattaacagtaattaagctattcaattttattatatttctatctgaaatttatgttagtgtgtagttttatattaagagtaatatgtttaaaaacacatttaatttttccaacagaatttattcaatagtctgacatttcttgatgatttataaatataaattaattatataatatataattacacatatttggtgttgtctgtggactttctactctgcagataggggtaacaccatgagagtatttagttttaagagaattgtagtttacatttggtaagattatttcctcaatttaaaaatatataattggttaaatatgattcaaccatatattgatttgaacttgattacatatgcattttagaataatatgcttgaaaaacaaccaatatatgatattaaatacaatataggattcaaaacaacatgtatgttatgactagggtgaccatataacttatcatctaaactaggatatttggaaagtgaaaagcagagctatgaataattacactggaataaaaaatatgaggcaaaactatacactcacccaaatttgtaacataaacatgtatatacttaactacataggcttaaaaaaaacttgaaggcactgtattgcaaaatatggtaggattgcacaattttttcaatatcttttgtgtatctcccaattttctgcaacacatttatattgtatatattattatattatttatttttaattattattttaaatttaataaatattaaaagaatgacaataatgacaaatgcttttttgatgattactgccagggactgttctaagttttaacaaataatcctcacacagtgttgtaaggtagattaaatcaattcccactttaatgtgtggaaactgagaaaaataaagtaaataaataaatacataaataaataataaaataaataaaataatttgcccaaggatacacacttagtcaatggaagcactgaaattttaaacccattgggtatacagtctaaaaaaatagaacatgaagaagcagttacaaacattgagagaatcgctttcccatagagttataattatgattcctcacattgcttctcttcctttgagcatcattatttttgatgcaacttttcatactgttctgctgtattaggatttgtggtgtcttctaacaaattgcaatatgggttcctgtgtaaaacttgagggcttggagagaggagggttttatttagttttgtcttgacagttgcaacttcagttgcagtcggagtagggaaggctttgctgcaagccaccttgctgagacatgccctgaggtggtgctctgtgttcatttcctaagcagaaatttgctgttttgagacctccactctgctcatagcatgactccccagagagaaaatcctagcagtgtctctggtctctgcttatagggcacctacagctgaggttggtgtaagacaggtgtctcgtggccatggctacctgctcaagaaggtgtaaagcccaggacaaatgcctaagtttcaccactcgccctaccctctgctacctttgccctcatcctctccatgtgagcaatcttagtagggttcttatcactcctataaggtgtttggagcctgattctgctcaactctccatacagtttaattttatatacaagtttttgtagtgtatttctacctttactgtatttggcctgtcacttatatgtgaggatggtgcctccttctgagatttatccattgatgtagctccccctccacatcccatattcataattttttttcatggaaagcatatgtggggacagtcttttgtgagtattccaatggcctttttaactagaagtttccaaagggttcacttttgagtgagtagaaggaagcactgaaaaaaaaaaaaaaagatggaaaatggggccaagactacccgaagattaaaagcaaagaaacaataaccacaaaacccaattagccctcaatcaaaagggtccagcacattggagattactttcattctgccatccatagctttctgtgcttctttctcatagtccactttggataaatttcaatcacatctaataacatcacatgtgtcactagacagacacaaccactttctgcaaaattcagaggaaaaccataatcattttcaactctgttaactagactttcctaaatgaatctatttatttacattctatgcccaagagctacattttgaagataaatagcagaattacctatttcttttgatggtgttttacatgacactgatgttaggagacaaccaacacagtgctgtaccaagtaacacgcccatgatcctccttttcctgagacagctattttcatagaatatgatagagcaatttcaccaatgtgtgactgacatgaaatggaatggtttgagctattatcatctttatttctaatttggtactaccagcgtttcagtttttaatatagttttaaaaaattggacacatgaattataaataatatctcataatgtggattaagaacacaaacagagagaagcagaaaaactgactacattgttgacagtagtcagagacacagggttctgaattttctcttaagagaaacatctccttaggtccccttaggcccatatttcaagttccaacagagtttttcatggaatgaggacttaactgagtgccaaatttcatgctaggcctctgtctacacatccttatttattatttctgagttatagtaattttatggttgaggcaacagacattcagataaattaattcacctacaaaaataatcaatttgtaagaatttgaaatcaaatctgctgagtccacattttagccatcaaagggccttttgatatgggccaaccaaattttcttgcaataggaaactttttaatatttattttactttattttttcatgaggggtcaagagcaaaacattctccatcatttattgaaattaatatcttcattaagtgtcatgacaagaggtataattaaaaatgtaacttgaaatatgtcaaaagatggatgcataattagtacagtttggggtaaaatcattgcattaagcaaagcagtccaccgtatataacctaattcttgtacatgatacgcacttgacaaaactgtgaacaattaaaatgaatttttgatgatttgtttgatatgtggataaattttttagaaccagcactggatcttctgaattcctggctcccctaactatttttagtctctccttatgaataagctgtcagtggtcaattatactggttggtgtctccactgtctccattttcttgggaatcttgaaaagtcaatcccttagggaagttttgtttgagaattaaggtggaattgatctggcagataaacattagattcccactgtgctttaaaccatgagaaggttatcaaattttcagtttttcctgatttcttgtcttcacagaaaagctctgtgattatacatgcaggacatttttaaatattgggcataacccactttagttgtccaggaacacattccagatccaataggagtgctttgtggataatctgtaagtggtgttccttaattaagagtgagcaacagggaatttgtaaatcaaaaacacatccctatagtgtaagccaattcagctacaagtaacatttattaacaacctattctagttcatacaagaaaccttgccaggtacatgcacaaaagttctgtcatttaactcttacaagataaagtagctattagtatcctcatttttgaactatgtaaataagattagaaaaggaaaccctagatgaagaacatcatcaagacttattgtaagatataagaagaactaaattgagagataatagcatgacctaccatagaatacttttgtagaatggaattgttccttaaatatctattgctatagttccaaatacaatcctcagactatgtcttaaatgtttttcttagcttttgtttgtttgtttgtttcttgtgtatctaattatggaacttaatcaccagcttgttgaggacaaatatgctggatttggttaccactacatctcaagtgcctttcatgcttccattacatcaggcactcaggtaattttgattgaatgagtgaaagagagacttgtttaaggtaacatgttttactagctcccattttaaatgtggttttagtacacctactttaaaatttatttagtattcacccaatgtctatgactttgctaagaattatggataattaatacagtaacagtatattttattttattttaaaaacctattttaattgaatttaatttttaggatagtaatacattcacatggttcagtatcaaacagcataaagaggtttacaataaaatgtattctacccttatcccccatttacccagttcttctgtgataggcaatcaatgccgttaattccttgtaaatctttgtaaagctactgtataaacgtataagtaaaatgaacaaaaaatccccttatctctttttatataaataacagctcgtaatacacactgttccacatctcgctttttcatctagcaatgatctagctttttcatctaaaatgatcttcaagatcattttatttcagttcatacagaacattctaattctttttataattgtatacaattccattcattgcatatagcataatatgactgctatggtctgaatgttaatgttcccaccaaaaattcatatgttgaaacataattaccaatgtgatgacattaggaggtagattagatcatcagagtgaagtcctcatgaatgggattaatgaccttaaagaggctcaagagctgccttgcttcttccaccatgtgaggacacagcaagaagacgcagtataagtacaagggccttttacctgccagcactttgatcttggacttcccagcctttaggatcataataaatagatttctgttatttataaacgacccagtttatggtattttgttacagcaatccaaagggactcagaaaacgatgtaacaacccatctgtgaatttgcatttggtttatttgctgtttaaattatgctactttaagtagtatatagaataaatttctaaagtggaaaatgtgggtgaaatatatgtacctttatagacctttgggttctcctcattgtcatactactagaatggtaccaatttaaaatcttaaatcctctgttttccaaagcctctttgacatgacggtttgttttatgaaactatatttgtctttgtttaatcttagaagtgaagaatactaactcattcatttttaaatttaattctttttatgatgagtgacatgaaaacatctttttatattttaaaagttttttattttttctttcctgtgaagtctctttaatattcctccccagtgtgtaattcagttattggtgattttcttattgatttgtaggagctatttttatttaagggaaatgaggcctttgattatgacatgagattgaagtagtttttttcttttgatctttgcattttgtctttgattatgatagttcaggcacaacaggaaacttctttttcctttctttttttccatgcattcctcttttctccctccctccttctttctttcctctcttcatttctttgtttttccttccttctttctttctttcttttattcttttattagaataattcattttttaccattgtggctattgggttttgtttactacctttaaaaagttccaccgggagtggtggctcacacctgcaatcccagcactttgggaggctgaggtgggcagatcatgaggttaggagattgagaccatcctggccaacatggtgaaaccccgtctttactaaatatacaaaaattacctgggcatggtggcacatgcatgtaatcctagttctttgggaggttgaggcaggagaattgcttgagccagggagtcagaggttgcagtgagccaagatcatgcctctgcactccagcctggcaaaagagtgagactccatctcaaaaaaaaaaaaaaaagttccttctcactccaaatttattcactaatatttctatctaaaaattttaggaatgtaattatttcagtattttttccttaaatcttgaaatgaatccagacttcttttttcctagatgattacacagattcccaagatcatttaattagtaatattattagcagcatatttgtcagtattaaatcgtatttatttattaataatgtcatattcttataaatgaatgaaaagatacataatgaaatatttcacatttatttggttctatttctattctgttctatggatccatatatttgtacatcattataatattcttaattattagggttttattaaatatattaaaatatataaaaggagagcatacccttcgttagctgtcttccatatcccccaaaatttgtatttgggttttatgaactcatttctgtctcaccagtgattactaatatatacttaggagttgattgttacacttaaaggtagctatgatgaaacatgagttaatgaagcagaagaagccaggctacataatgagagaagattaaaataacagagaaaggggggaaaagaaaaaaaaaaaaagcagataaagattgctttgcttctggaaatggcaacccaactaactctcttatttttttcatagccaggaaagaaaacttactatcatttccaaatgacaagcctcaacccaatttaattagctttaccttgagatccagagaccaatcctgttctatgtagctttatttgactcctaacatcccttgatctttctattctgtggggtgtttcattatctaaagcaaatatatactacttaaacataaaaaattgtaacattatgaggggtgactcattactggtgtgtaatatcatggtaccagacattactaatatgtaaggagcatgagcagaaagacaccagcctgtgtatagccatagactactatgcttttaattgttttgagattgagtgtctcaagatctagataaatcagcaagatgaaagatgctgaacactgacatcttctttgtgccttgtgaaaagaaacaaatgacatctctgagctgcttagaaaagaattatacctgggatagtggtcaagagtggggagatatatctcaggagagtctcaggtagtttgagtttttttcctgttcccttcataacaaacatgattcacagcaaccattgtagtattatcagtaaacaaggctcctgtttacatggtgacctgaaatagaccctgtagccagacatatccatccttccttgttccaaacacacaaattttactatactgcctttgtagtcactaccattttccttcaatggagttactttcttcctgcagtaatctcatagtaatttgtacactcttctcaaacaatcaacctcaaaaggatctaccatttgttggacacctaatacttcttttgaacacttgatctcattttatctcagcctctctgcccaaaaaatcatctagattgatattactgctgtcatttttcaggctagatgctgaatcctatttctagctgaagcttaggccatagcttcacttcaggctgcagcagaataagggaagggaagaatctgagtcccctggcttccactggggtggggagtttcctcagagatagggagaattcttccaaccaaaggaaatttgggaaatattaggaaacaggattatctgctgagaaggacaaaaccattccactgtaaatcaattgattaatccacatacaaacaacaggttttcttgcacaggaaaaactctgacacatattttactttacttttgtccttaaggacctgatgataggcctaggtacaccatctacttcacatttttctaatcttcctgtttaatgtcgcaatcaaacaagaaaagaagcagctttacttgttccttgtaaaccatgttgtccctcagtgatgccagcatcttccactggctcatattgaccaatatttcatacaagtgttcttgcaccttgcagttgcacctagcatcttcctgatttacagtctcagaactcgctctgtagacaccttttttttttctaaactgaaaacgtaccgtttgttttccatcttcctgtaactcctctaagaaagcagatggtggatcagatctcaggccaaagttctctccagatatgggatataatccaagcaacctggtacctgggaactcatttttactcctgtgagctcttatccatcattctggacttcagcagctgctcttcagcgtctgtttattcttttctactgaactcccttctctttgacagaaagcgtggctacagaaaacattctgactaattctgtttggggtcagtcatgaataactttattccaacagcttccaatggcaggcaaatcctttcccggttttacatactaatgtaaaataattctcaaggataaatctatgcttaacatattcaaattaaactttccagtcagataatatattctccttaatgtgcccagtgtatgtagttcgtagtatacactaactgcaatctactgatttatttgattgtgcacctaaaatatacaagtagtacatttcacaagtaagtacaaattcttcttttcagagtggagaaagaaatatatggatcctgtcctcatggaacttatacagatgataactaacactagttactacttaatttaaaagtggtacaaagtaccaggaagtaaatgtccagaatgcaataatgatatgtaacagtgaaacaaactggaccttgttggagagaaggttttcaggaatatattcattcagtcattcattcaacacttgctgtgaaccaagcactactgtttttttttttttcttatttggaaaaaagctgcatatttcattgactcttctgaacaaaggtcattaatacaaaagcacttgtaagttgctttacctggggaaagtattttggtgatttttatctaggtgaagttttctgggctcaaaaatcttttcctaacaggttgattttaataacagtccaaactattccaaaacaaaacaaaactgttttcctctcttcctaaacagaaacaatggcatccggagctgaaaatagcgttaattacatgaaaagtttgtgatgcacaggatttgctctggagtatgaaaagtgtgtcttagacttatgtttatactcacataaaatgagcaaaaaacgatagtcctcttcaggaagagattatctgatgaaaatctgcaaagatacttcaatctttctatgtactggagagtttatgaagccccaaccactgttctaagtagtgagacactttaccactttttgtacacgtgttgggttggagagtgacagattgaaaataaatatggaaattactgaataaacttatcagacagtgataaggtaattcagtagagaatgattagattgctactttattctgagtttcactagagaagaaatatttaaactgagatctgaataacaagaaagaaaattcttcggggaaggagcattccatagggagaaaacatccatggaaaagaccttaagcctgggataaacctgatatgctcaaaacaaaataaaacatacacacaaaatgtcagaatgaatgatgcaatatattggatgaagaggaatgtgatcatatcattgtcatcctaatgacgacccctttgagagtgaaaggagatgatgctctgtataataataaccaggccacaagcaggcatgcagccccttctggttgaataattgagaaacgaaagtctgctagaaggagaggctcaataaatatttgttgaaggaaggaataattgctctcactctaatggaatttttttttaaatttcttaacaaattgatttaattaaatctagttctagatgtatttatattttaaaatattttaatttgggcatttttggcttgatttggtcagtgtctttgtttttagagctccagatggctccaaaatatttttgttctcagcctttctctatgttaatactatcagtgaggccaacttagacaggtgtcccatgtgaattgcaattatttcacctcaaatggtttgtcttaccctagtcaaaacaaagcagctttgatttactacagttgaggtagaagagagattgctgaaggttacaagcctgattctgcttttattgtgtcatttgaggttgacctttatgctccagtaacctccctgaatctgtgtttttccaagtgtctgtaatgctcagtgttgggcatagccctggatgacactttcagatgaggaagtctgctgaacatctggctaaaaagcaagttttggagagcattttaggacttaaaatataaagtctaacagttttctgtattataaatgaccagatcagcatctatagatgtatttttatgagtaataaagtataaggggaaaggcttgcagagagaaaaagcaaggaagagaagtatgtcaatgaatacaaattctctcatttgataagaaaatgtaaaattatgaataaatgtatgacatctcattgcaagatatgataagactcaatttcccctgtttattgtcaccgaatatctaggaaacaaaaattttcaggacttcagtattttagcaggaagaaatctagtgactatagattgcctacccctcaccatctcaccagtgaaggtcttggtcagtagtctgtagctctccattttctgccccctaaatgtgtcttgcagtgagtggtcagtggtcaaatgaatggaacagtagaggcacttctatatcagcatgaaaaaccagtgaaatgctgtcttgccaatactgtgtatacagagagacatttataaaataataagcaggtaaaacttgtcttggcaaaaggctggctcattacattcagtgaatgttaaaaaaaaaaaaaagtcctctgtggtgataagtaaaatagaccatcaccacccaaatcaagccacattaacatcttgaactgctatgctttggatatggtttgtccctgccaaaactcatgttgaaatttgatccccaatggggcagtgttgggaggtaggacctagtgagagatgtttgggccatgggggcagatctgtcatgaagagattaatgtcctcttacaagtaagttctccatctaaagggaatgggttagtctggtgttaaaaggagcctggctttcttggtctctctctctctctctcttacttcctctcttactacgcaatctgtttgcatatgcctactcccattctactttctgccttaaattgaagcagcatgaggccctcaccagatgcagctgatacatgctgagagtaaattaaaccttccagtcaccagaattgttagccaaataaacctcttttgtttgtagaaaatcttgaactttccagtcaccagaattgttagccaaataaacctcttttctttgtagattgcccagactcaaaaattcttttataacaactctaaacagagacattaaccaacagcaggagttaatgaaaccaaaagtatgtcatgaggacagaaaatgtcaaatattttaccaaaatctttgggaagtctttcaaatgtcaaaccaatcacatcactgagatcctgcacatagagctcctggttacctcttgacacaggtagcaccctctaaagtgagagcaccagtggtgatatccttagccaaagtgatgagaagttgtatgttccagcaaaagtagcataacacaaaaacatacaagtgtttgagacaaagaagactcttaaccagggttcctagctttcattgagaaaatcctctcaatacatccttatcactcaaaaaattgaaatccattataataataatcatactaatctattgatgaaataataagaaacagcggaaggaaggatggtaggtaacagtcggcacaagacacacaaagaggaaactctatgggttctgcatgcgtgagttgctgaaaatgagctttaaggttaaagccaggagtttggaattaatgtgtagcatgtgaaatataaaaaactccattcaatgccctcaattttatcagaggattagggtaacctcctggatacttgcagaaaaaagaaagccagcaataagcatttggctgtggcttggaggtttaatttactctcagcatgtagcatgggaacctttttgcctgagttgagaaaatagcctataaactagcaccacaaccccagaaaaacacagggccccagtagagacaaacagaagaacttccaacagagatgcccacagccaaaagcacatctggtctctaaagaataactcatgatgctagtgatctcacaggaaaaattacaacaaagataagaaaaaagcatataagaaaatcttcataagagaattgtcagcagatgtagaaatcaatccagaatgcagccaaagagaaaacatgaacaatgtgtgaattaaaagcagataaatatagcataccaaataccaaggaagagaaaaacattactctgataattaatagcgaagcataatcatcaaaaaggcaaagtaccactatcgtctctgtcatctaacttcatactgaagctttaagtaagcctaataacagaataagaaaaaagagaaagaacattacaaaatgaaataaaactatattattctgcattacagaggctatggttttatctacttagaaaataaaaaaataaataaatagagaatagctaccaaaactaaagaactaataaaatcagcatacagaagacagtcttacatacagacaactataactaattagaaaatataattttaacagattttttaataagaaatctattacattttctgattttattagtgtatgtacatggcaatggcatacataattaaatgtatattacaaatgtaaactaagtatatattgtaaaaaaattaaaaatatcatattcccaacagcttcaaatgttatataacgtagactctcaggagactaggtactcttagaactagaaaaaaaaattcaataaatagcactgaggaaattgggtgcccacatgaaaataattaaatgtatttcatatttttaaaaatctacagatgacttgagctaattataaaaaaaactctaaaactttgagaagaaaatatagaatattttatgatatatagcaaaaatgtaatattttcaaggaagaaagtaaaacatatcgaaaccaaagttaaagcaaactgacttctattttatcaaggcttatctaaaaacacaatagcaattcttcagaaatatctgtggaacccttctaaattaattataacctcactataataaaaaagtaatatcttcaagaaaataaggcatttttagagaccatttgtagccatagtgcaataaaacaagaagcaaaaacaaagtaacagaaaataacccaaatactttcctattccaacaaacaaaaaccaaaactcttctaaagaatccttagcttaaattggaatcaaagctgcaataacaaacattttgttagaaaataacagtagacaatcatcatttaaattctgttgataaagtgctcagcataaaaacctgagactgaattgctacttttcagtaaaaacaacataaaccagaagtcagaaataattttaagagaaggaaaatcaaaagtcaatgcatttgaaaaaataaaattaataaaatatataaaattaagaaataaatcagtttggcttgtaataattccagtaatggaatgaaataattatttagaaagcaaggaaaaacataaatggaatgcttctcagtattttcaaaataaaaaaattaagttaaaattataaaacatatatatgtgtatgcacaaatataaattgtatttttttctttttcctttttttcttctttcttcctttcttccttccgttctttcttctttctttctttctctttctttctttctttctttctttctttctttctttctttctttctttcttttctttctttcttctttcttttcctttctctctttctttctttcttttctttctttcttctttcttttcctttctctctttctttctttctttttttttgataggacctcactctgttgcctaggtgggagtgcagtggtgcaatcacagctcactgcagcctccgcctcgccagctaggtttttggattgtttgcagatatgggttttcaccatgttgcccaggctggtctcaaacttctgggctcaagcaatccacccaccttagactcccaaagtgctgggattacaggcatgagccaccacacccagccacaaatagaaattttccaatttccattatgaatgagaaaaatgaataaaacaagaattataaaattaaatttttcaaacgctaattaaaaatacttgaaaagtttaccagccccaatgtttatataattccatgccatttaaattactttaaagcataggccatacaatgcaaactcaattcattgaataagacacacaaatgatacatgaaatctgacagtgatagcaatacattgaatatataaatcaatttgaattatgaatagtaatgcagaaatgtggaaatcagttcttccgtatacatatatacatttgcatgcatgcctgtgtgtctgtgtatacttgattctaaggaatgaatgaaaataatagttaacaaaatagcctagactttattcaatgtattcaactcttgtcttcaatatattccactgagaatgttgtagttataacactatatcctgtaccaagctttccatgtcaactagctttttgtttagtcacgcatagtatgctgtggtttgaatgtgtgccccaaaacccatgttgaagttcagttgccatggtgatgatattaagagtcagggccgttaagaggtgattagtcctgagggctctgccctcatgaatggattaatgctgttattgtccatctcctctttaaaatgatgcatccaaaagtctctgaaatgcatttgatttgtataaagagttattgccaaactgcccttttcagtgacaacatttatacactaacaaacatggttttttgtgacacctgattcttgcccagtgtttatggggtacagtgatttcatgaaaagcacacctagctgaaatttggggaacaattgtttcatgtagaaagaatgaatcttagattgtattaaaattcaaatatgccatgacaaacagcgaccttttccagaggttttgtaataatcactcagcatgaggatgtcaattaataaatatgtgaaagcacattgataggccacaggaaaaattcatgtaaccatcctgaaatgcagaaagtattaaagaaatatccatttatccttaaagactcttagtaaaatatatttgaaaagtactttcctcatataatgaaagataattatctaaaataaattgacaaatatcaaaatagcaatagaattatagaggaattcctcttaaatttaaaacaaaacttagacttgtagcataaaacaaagaaaaataaaatttaaaaaactattttggattgctgaccaaattaataacaaataatcaaaataattaatatacgagtaaagaacattatcaatatgtgcagttttttgtacttggaaaccccaagataaatgagaaacaactttgaacacttcccatgttcaaaaaaaaaagtgactgactttgaaatcttcatacaaaaatcatttaatttataatgtcttatctgtccagtatggtggccattggtcatatgtggctgttgatcatacagaatgtgtctagtccaaattaagatgctctgcaagtaaaatatgtgtattagaattcaaagacttcatgtagaaaaaaagaaatgtaaaataactcattttactttttaatttttattagatgttgacatgataatatttggacatattgaatgaagtaaaatatgttaaaattaatccatctgtttctttttactcttttaatgtggatagtggaaaatttttaattgcatacatggcttgcatatgactcacattatatttcctttttctttttttttgagacagagtctcagtctgtcaccctgaagtacagtggagtggtcttggctcactgcaacttctgcctcccaggttcaagagatttttctgcttcatcctcctgagcacctgggaatacaggcatgcgccaccacacccaactactttttgtacttttagtggagatggggttttgccatgttgaccaggctggtctcgaactcgtagcctcaagtgatctgcccgcttcagctttctagagtgcttggattacaggtgtgagccaccagacccggcttcacattatatttctattaaaccacattgccctatgcaaatttttttttttttttttttttgagacttagtctcgctctgtcgcctaagtgcagtggtgcaatctcggctcactgcaacctgtgttcaagcgattctcctgcctcagcctcccgagtagctgagattacaggcacccaccgccacgcctggctaatttttgtatttttggtaaagacagggcttcaccatgttggccaggcaagtctcgaactcctgacctcaggtgatccgcccacctcagcctcccaaagtgctcccaaagtactcccaaagtacaggcatgagccaccacacccagccagcaaataaaaaatttttaaaaaagataatatgatagggaaattatttctttttgtaaaagcagtgcaaagtcagtaaactctaggtataaaaatataagatagtataagatgctgcagcaactgtatgattaaaactatgaagctatgttttgggctgtgtgtgtgtgagacagagagagcaacagaaagagaggaaagaaaagagagagagagaaagacagagaagaaggttcctgccatgctccttatttgaaaatcatgtcatatgacaaagtgtagtttaaattatactgcctagaactctttattcagtatgatccaatatcaaattatcaatattataaagaaggaaatgcttgctaaagtgattggtaaattcaatacagttttcattaaaaatatattttggaaagggtttgaactattttaaaattcttcagaataaacacctgagaaaaccagaacaaaaaccagtacctatgaacaatagaaaataaagaagacattttaactaagtaagaaaataatgcattatttaatattgggctagctctctaaccatatggaaatgaaagtataaaattcaattatttttcttacaattcacacaaaataaattttagaggattaaagttttacatatgatacaatgacaaagtaatataagtaaaccaaacaatcaaaaatataatcttattggatggaaagcatacttacacatgatacaaatgttagaattattatagaaatgattataaataaacagaaagtgaaatgggataagttgttcaacctcactgtagcgaagaaaatgcaaactaaaggatgctaattactcagaaattgaaatttatcaccattcattaaattaacactattttccaggagaagtgacaaataccaaaggtaggaatataggaatgaagatgttataaagaaaaaagccataacaaacaatcaattcagtaattcattttacttttctcttttcctcatgcaagttccctttgatggaaaattattgttggaggaatgtggtatcctgatccaaaatgataataatgtggtatgcatataactatttactttcttgtaatgtgtagcaaggtttgtagactgaattttagtttgtggaatgaataaatatcatctatatgaacatgattttttgaattattttgaaatgtcagctcttaactgacatagcaagtcatctctaagtaataaaatttaatatcagatttgatttccactcagaatttgtgtgtttaaggttttcattgcaaaaaagataatatagctttgcagaagttagacagttatttcctattcaattgctttgatgtgcctatttctttgaacaaaatctctttttaaatgctcttttgatatgtgagctcatggttgctctgaaattaatcccaaatgcaaaatgctcgtgaagaatttagagtttgctaaaagtagttattttgatacatttgttgatattttcttgatagggaatgaaccataatttactttaattatttttacgtgtgaatgtacgaaagtaaacagcagcaaccaccactttctaaagcagaaagtattttgtggccaggttttctcttggctcttaggagggccttctcgtctttattgtgatgctgacatgtgatacagacaatgaagactgaagtggtcagcctgaacaataacaaaaatgaccacaactagtcacagacttagaaaacacttctttcacacttttgtctataaagatctgcttatattgaatggaaatgaaccctaaaaatagtctagtttaaggataaggatcacattttataatttgcttgaggttggttgggctagtagctaatttaaatataggtctaaatgttctagtataacattgtttctcttatcctttctgtggtcttgctagtggggatggagtgtgggtagagttatcttgtagttcagctattagaaaactgtttcttcttcatcccagaataaatcttctacatcaagtagtacgctgattaccttctgtaattaaagacaaaaatgtatacatgtatttcctatttcatcagtcagtttgactgatatctgactccttacttattaaatgaagatattagcatccttagtcttttttttaatctctcttccctaggcccttctgtcttcccatttctgttgtttgttaagaacacttaaatatagcgtcaccataaatatatttttcttaccttactcataggtatattttgaaatctagtactctacgaagactaatcaccttaatatgtggatatattgtggatatatatatatatgatatatataaatccttatatatatatataaggatgatatatataaatccttaatatgtggatacaatgatccattgtaaaatcaagtatgaaattttgattatatttcctttcagtatagcttcttggattgttggtccagctagcaactctattaattctctccctccaatactcacagtgaccagttatttcaccttgtctcctggagcacccatctatcacacaaacagataccttctcaatctgctgcctgcatgtcttcttgggatttatctgcactgtttgcctgggttgcgtacttcatttttggattttcttgctttcctgtttttaattttgtttttcctcctttggctaaataaggaccatatattccctgagtatttctagagtgtctgaaaaatgtctttattctatgctcacactaccaggatcttttagcatttttcttcacgggttcttttaatctagagattcctgttcatctgctctattaaatacactttattatggtctggatagttttcatctctacattttattttttcttttctgttttctcattcttaaatttctcttggttggctattggatctcctggattggttttcttaatcttattatcttaccttttcccagtctttgtccatttcttttatttattgagaaatgttcatatattcctagtcttttatttattctttttatcttaactataacactgtaaattccaagatatcagatgtctcctttcctcaggaatttccattacattttacaggtgaaatactttttttgaatgtctctaaggatattactgttggtaatataatattttcttattttctatgaattatctctgttctctctctctctctctctctctctcatcctctgttcatgtttaagagtaaagtatgaggagttctttgagaactctgcgtatgtccatagtgctcctcaccttggagcaggccttcattttaagatgcttgacttggagctggtgtcattttggaggcccccagataccagaatgtcactggagtcacactctctcaacagatggccttccaggctcctttctaaaggcggatgcctgaccactgactgttgcaagtcaagagtaggagaaatgtgtctaggagtacgtattgtatctgtccccctccccacttcatgtgttcagttccatgtctttctttcactttcacgtgtactaggcacgtttttagtctcagacttctctgtggttttactaggagagctgtctcacttctcagttgtgtcccacactgcatttttctccatcccagttcaatagttaccactcttccatggacatgtggccttcaagagtttatagaaactttttataccctgatggttctttatcaacctcttgtttgtcgtagtgacctatttttttatacttacatttatttggttcccatgaaggaaagaaaatagatgcatgtggttaatccctcatccttaggctagaagttaccccaagaaattttaatttccatgttaataacccacctagcaccaagtaattgtagagattttcatctcttcaagaaaacagataaaatatttgtctcatcttctggctttctgtatgcagtatataaaacatttttctttcactgatagcaattcatgttattaactattttaatgatataaaatatctcactttattttaagtaatttaattttatctctttcatctgattaagatagattttctagcttcttaagttgtttaatgcaaagacaaggcttttgacagaaaatccatgtcacagtctaggaaatagcttttttgtgtgtgtacctacatttctgacgttcaagtttgttcccaaatttaaactcaaccctcaagcaatttgatttttgaacaaaaagaaatgttatatgtgttctctttctatgtatttaagattctatacgctttaagaagcaattactaataaaactgagattctaacagtcaaaattgtcagtagttttatcatcatctttgtcagtctttgacgactacagatgaaaggctccaaattgtactagattatttgtaacattttaacccataaagaaaatggaaataaatagtttgtgaaatatggttatcattaccaacctatatgtttttgccattagaagtcattttaacttttagtacataacaactaggatattacataattctcatgtgacttctattctttttaccaccctagaatacctgaagcaccagttcaaaggctgagttgtacttacatattctaaatgtttccatagttcctgcaaatattgactgatatcttgagaaaatataccttcaagagtttaatcatttaccttaaattgaaaatttgtattttaatggattctgggctgaattatgactgtcgattttaaataactttaattacttgaatttaggaaaattaataacataatttcaatattaaaaaaatattttgagatatatttctcaagtataatttaagagtaaagcagttcttatcactgtgatatgtgtttaggatatgtgtgattcagattgctgattttaacaaataactattctgcacagtgaagtagaaagcaatagactaggattagaagactaaattttaaacctcagctgtgaaaaatcagaagtctaaaaattactagcacaagtcaaaaaatcaagcctttcttttctcctaagtgtggatttatgtaattcttcctacatatctttttttctctatctaaattgtataaatataaccaaatataacattttttgtgtacacgctcagacatgtatacctaatacagtgtttaagacctgcaagatttcattgatgaacaagttgctttgcttgatattaataaacttgccaatttaggacgtgatgcagacccagccctcatttctgtaaggattgaatcctgagtctgtaacttagccaatcataatgttattaaagtagaaatattctgtacttagtgtgggatataagtgtatataaagcaaccatgaactccacacctttaatgaatagaataaaaatgagtcattatattattcttatttatttagtttttacatgtactcttactctccattctgttttttaaatatgaaaatgaaatagcagcatgactatgcatagtatttcaactacaataaattataaaagtgaaaggcttacattttaatgattataataatttagaaaggcatttcaaaactttccattattttctattcaagtactttagtaaaatgggtgggtatatcaagaatcttagcagagtttacaagacactattcctggtgaagacccctctttccaaaaccctgttgtgaacaaagtcacgttcttactcacagctctattcttggaaacacattattttgcaaattcctaatacgacgattttctaaaaccgtcaacacaaacggacatcctagtttgtaccagaatatgtctccctcaggaggtggcttgggcttctctgccatggctgacagacattgtagaagcagagagtcctgagaaaaacagaaaagccctcagatcagaggaggaaagaaacaaacactaggaggtgttttggcaatttaaacatattccaggttaagcagcatcagaatggacaccagggtagaccataacctcagaagggcatagtagatatgatagaaatgtaggctgagattggagataagggctggcaggaaactcattgtcctccttggagctaagtggagcaaaaaatggaactctattttgggtgtcttggacaaggaacagaatactcaggagctctagggaaaaatggaattcgggtctcccctggggacatttatcagaatgaagagaaaaaataaacaggcagctgcatcctaaaggtatcaagtgagcctctggcatgaactccctgagagttggtttagcaaaagtagtaataatgtgcagatttgtgggacaaagctttttgaattaatgatccaaggatttatctctggctcctggatggtaatgaaagatcatgcaagtgtctcagtacaaccagctagggtgagttaggatgaagcaaagggtgccaggcagattaacattctggtataaatttgttatacttttatcaccttccttcttaaacaagttactaatcttggaaaaattagaaataatatgagataaaatttgacatgctcttaatgaactgatcaacttcaatgatctaatcgagtcatatgaatgaagtattctttttaacgttaaaaaatgaaatgttttcaagtgattaaaaatttaaaagaagacataaaataaagccagtattttattctataaccacctatgttgggatgtaaatcataggtactatagttgctgacaagggttccattctggtgtatggaaaggcatcccacagttatagtcaggctcatttactgtggactcgtgatgcccccagcagtctggctgatcttcagaagtgtggcaatctgttcttattccatgtaagtttgtctaccaagctggttgccgcagagggaaaaacattcttactgcttagaggaaaataaacttattcacttaattattcattcaacacttaccaaaattattaatacttaatcagtgctaagtcctggatgagctattcctcattcaatgaagaattgatgaatcactatgttataacattagtggctgacatcaaattgtccatctcaatagcacttcaagcaaacaaacaataaaagtgagctcattatttttttttcctcccaattctgtttcctttgacatttatatcaacattcactctgttgtctaaatcaattttggatttacctttgatttctccctcttacttaacactcatattcaaacaaatctttgtgctttatttattcttcatctaaaagtacttcaaaatctatttccttcttcattgtcatctcagtttaaactctaccatccttccacatgggattatgaatattgtctcccagccaacttctttgcctttctcttttgttgaattaacttttgatgtctactttttttcaaattttgaggtaagctaattttattcttttttaacataaattttattatgcatatttgaggtttataacgtgatgttatgggatacatacagagggtaaaatggttactctagtgaaacagattagcagatctatcatctaacatagttactctgtttatctgcttctaggagtcagaaaacatatagttacttttcattcattcattcattcattcattcattcattcataatctactcatttaatgagaattcttagtacaatacaattttattaatcatagttgtcatgttgcacattagatctctagacttgcttaatcctatatatctgtcactttgtgtcctttcctgtatctcccctttccccactcccttgtgcccttaataaccactgttttattctatatctctgtatatttgtcatcttttttttccaaatattccacatataattgagatcatgcaatatgttttctgtctgtgtttggcttatttcacttaacataaggtcttctggggtcatccatgtcgtaacaaatggcaacgtcttccttttaaagtattacccatggtttccagtttgcttccatatctttttttttttttttttttttgagatggtctcactctatcacccaggctggaatatactgatgtgatcatagttcattgcagcctcgacctcctgggctcaagcaacactctgacctcagcctcccaagtaggtgggggaacaaacatgtgccaccgtgaccaactaattttttattttttgtagagacaagatctccctatgttgctcaggatggtcttgaactcctaggctcaagtgatccttttacctcagcttcctgaagttctgggattatgatcatgagccaccctgcagagcctgtttccgtatcttggctattatgaataatgttacagtgaacatggagtgaagatatctttgtgaggtggcaatttcatctcctttatgtatatacctggaaatgagattgctgagtcatatggttgttctgtttttaatttctttagtaacctccatactgtttttgataatggctatactaatctacattcccgccaactgtgcactgggttcactttccaactgggttcaccttgccaacacttattgcttgtcttttaggtcatagccattctaccaggtgtgatgtgattatatcctagtgattttaatttgcatttccttgataataaatgaaaatgaggccaaaatgaaatgttgggcattgttatgtcttctttggagaaatgtctgtttaggtcctttgtcccttttttccttgggtcatttgattttcagctatcgggttgtaaatgatcttaataaattttggatattaatcccttatcagatatatagcttgcaaatattttttccacatttgtagattgccttttcattttgttgattgtttcatttgctgtgtagaagatttttagtttaatatagatccatttatttatttttgtttttgtagcttgaaatttactttttcctttccaatttggatgcttattgttattattttatcatcattattatcaattaattaattttcttatcttatatctcttgctagcacttccagtactatgttgaatagaagtggcaagagtgggcatctctgccttgtaccagatcttgatagaaaagtttacagttgttccctattgattataatgttagctgtgagattttcattaatagcttttattatatggagaaacttttcttctgtaccaaaactgttatgtgtttttatcaagaaaagatactgaactttgtgacactttttttctgcagctgttgagctgatcatgcttttatttttcattctgttaatgtgatatatcacagtgactgatttgcatatattaaactggctttgcatgccagggatatatcacacttggtcatcatgtataatttttttgacgtgttgctaaattagttttgctagtgtttcattgagtattgttacattaatgttcattagacataatttttttgctgtgttgctgaattagttttgctagtgttttattgagtatttttacactaatgttcattagacatattgacttccagttttcttttcctgtgggatctttctctagcttaagtagaaaggtaattctagccttgtaagatgtttttggaacatcccattattttgggaaagagtttgagaaggattggcaataattatttgaatatttggcagaattcaaccatgaagtaatctggctctaggcttttctttgtttaaaagtttttaatgtcttcttcaacctctttattgtattattggtttgtttaagcttcctattttgtgttgattcaatcttggtaggctgtattttttttctagaaatttgttcatttcctctaggttatcaatatgttaacatataattgttcacaatagccgattatgatccttcttttttatttctgaggcatctgttataaggtcttcactttcatttctattttatgtacttgagtcttcactctttttttcttagtctagttagatgttttttgattttgtttactttttcaaagaaacaactcttggttttattgatttttttgttttatttttctgttctctatttgatttatgttctgatcctttttattccccagttttattttcctttttcttttttctttttttttttttttttttttgagatggagtcttactctgtcgtccaggctgttaatgtggcatgatctcagctcactgcaacctctgcctcctggtttcaagcgattcttgtgcatgcctcagcctcctgagtagctgggattataggtgcttgccaccatgccaggctaatttttgtatttttagtagagacagagttttgccatgttggccaggctggtcttgaactcctgacctcaagtgatctgctgcctcagcctctcaaagtgctgggattataggtgtgagccaccgtgcccagcctattatttcatttcttctgataaatttgggtttagtttcgcttcttcactggttcctagaggcataatatagggctatatatttgggatcttttttttttttttaagtaggcatttcttgctataaagattcctctagaactgcttttgctatatcccataggtttttatatgttgtgtttctattgtcatttgactcaataattttttgttaaattctcttttgatttgttctttgaccaattggttgttcatgagcatgttgtttaaattctttatatttgtgaatttaccaagattccttctgttattgatatctagtttcatatacttatagttcaaaataatactagatatgatttctatctactcaaattttttaatacttgttttgtggcatatatggtgcattctggggaatgttccatgtgcacaagagaagaatgtatattctgctgttgttgtatggaaacttttatacatgtctattaggtcaatttggtcaaaattgcatttcaagttctatattttctcattgattttctaactggctgatctattattaatagtgaggtattggcatccactagtattattatactgttgaaagtgaggtattgaagttccctactattattgtattgttatctatttattattttatgttcattaatattggctttatgtgtttaggtgctttagtgttacccactcccctacaatttatacttttgttgtcacaatttacatctttttatcatatatttcttaatagcttattgtagctataattgtgaccattttgacttttaaccttcatagtagacacttgaaatatttacacattgtcattgcagtaatggaatattctgaattttactataaatttatttctatcagtgagttttatacttttatatatttccattatagtaattataatccttttatttccaattgaaaagctaaacattttttgtaaggcagttctattggtgatacatcttctgacattttgcatatctgaaataatttgtttctccttcatttttgaagaacagctttattggctataccattttaggttggcagttttcttctttcagcactttgactatcttatctcattcttttctgacctgtgatatttctgctgagaaatcactgatgatctgatggggattcccttttatgtcacttgacattttcctcttgctgattttccaattttctctttgtctttgacttttgacattttgattataatatgcctcagtgagcacccctttggtagaatatgcttgaagacttttgagcttcatggatctgtatgttcatatctctcacccaacttgggaagtctttagctattattttgtcaaataagctttatgtgcctttttccatctctttaccctctgaaactctcataatctgaatatttattcacttaatggtgtttaataagtcccatagactttctttttcttcactctttttcattttttttctctccgggttattttaaaagatctgttttcaagttcagacagactttttgctgcttgatctagtctgctgttgactcttacatgtacttcttatttcattcaccaccttcttcaactcgcgtatttctgtttggtcctttcttatatctatctctttcttaaatttcacaatcagattatgaattattttcttgatcttactgaattgtctatctgtatcctcttgtatatcatgaattccctttatatgattatgtattcatcttcaggcaatttgtaattttcatttatatggggttagctactgaggaactgttgtgtttctttggtggtgtcatgttcccttgctttttcatgtttcttgtgtccctgtgttgatatctgtgcatctagaggaacagtaactacttttaattttatagattgttttttgtaggaaaaaactttcatttgcagatgggtcttagggtgtcatttggacagggtccattgcctccagttctgtgtgagtgcagtggtgtagcctttgtgtatcttcttcagctgtgatcaacattattgataactgcagttgcctcagtggtctacactgtaggagtttgtggcagcgtagtggcagggtaagttgtatggttcttggtgataagggctttaggggtcttcctgtttatgtttacccacagtagagagactcagctgaggggatccctcttgctgtctggtttgacatgtcccataggcagccatagtggtgctgtactacaagacacaggtactcagagtggctgtagagctgagggcctgggctcaatgtcttgtttcattactataacacctgtgacattgatgcaggttcattctctgaggtgcaggtgggtgctgcagtcccactaagctagggtggtgactcttaggcactcctcagtagcttgaaaccaagagaacagggaggtagttgtgactctggtcctggggatcaaggtgtaatactgacatagctctagggaagaattggtgttctacaggcttagtacttatggatccagccatagctgcaatttagatcctggaagcagtggaggacagagacattttgagcactgagagagggggtactgtgtagtggtggctccggaccctggagtgctaggacatagccgtggccaaagccctgcaaggttggctgcatcagcagcaataacccaggaatgttggggcacggctgtagcttggactccggggagtagggggcaatacaaaggtatcttcattgcccatggaggtgagatgcctcagcagttcagattccaaaaggcttgtacagattcagggaagcaaggtgctgaagctcttcagcccagaggacaaggtaacccagctcagccaaggctctttttccctggggggaagggtgcctgttaactcctgttccagggaatacagctgctctgctggactggggtccaagcattagattgcttcaggcactgagcgggtattgctgttcttccagcttggcaacagtgtctctgctgggtgggagcacatgattcttagggactgagtgctgcatgggcttggatgatggaattgtgactgatcctctggactaaagctcaaattcctgagggacaggacactgggttggtgtactagtccattctcaaactgctatgaagaaatccctaggactgggtaatttataaaggaaagaggtttaattgacttacagttctgcattgctggggaggcctcaggaaacttacaatcatggcagaaggcagaggagaagcagacaccttcttcacagggtggcaggatggagtgagtgcaagcaggcaaaatgccagaagcttataaaaccatcaggcctcacaaactcactcattatcatgaaaaaagcatgggggaaccgcccctacgatccaattacctccaccttgtccctcccttgacacatgaggattacaattcaagatgagattttgggtggggacacaaccaaatcatatcaattgatttaggtactgaggggctgtggctgctttctggctcaagtatggcttcttggctgggcaggagtgtctggtcctttggtggcagggcaccacatgggctcaggcactgaggttacactgctctgtggggtcaaaggctaaatttccgaggagtggggcagctggttggttcagttgctgggggagtagctgctctcctgagcctaggctctgtgtagacaggggtggagctcagcagtgactgggatgcgggggagggattctctcctaggcaatgtttcccaaggagaaggagctgcagcagtttaactggggtctggtacttttccctgtacgagaatgtggtgtaatggtagtagagtctcagggatgaaagaatgcagtggctacttgttcctggggcagggcatactctatcaagggctccggtttcaagattgtgatgcacagtagcagcacggaccacagggggtggggtgcaatgtgagatcttttagagtagtgcagccatgtgaactccaggaaacaccctaagctgggcttagaacctgtgaacactgcagggtttttcagtaacaaagattataggtatccactgtggtgatgaaggttgctaggggcctcctccttcctgtttccatcatggcagaaatacttcctgtttctgagctgattttagctgggggcatgagtggcagagtcaaggctttctcgtcttatctctatgcagcccttctgagtttctgtgatccacaggggctcttcacggacctactctacttcagtgctttcctttagttgctctgaccaaaatatagttattcatttgttgttttggtaactgttttggtggagagggatgagagttaggcacctctagtgagacatcttgatgatgtctcaaaaactctatcttcctattgttctattttcaagtttgctaattccttgtgacatattttttctgctaagttcctgccggaagttttattatgattattatatatttcatttccaaaattttaatttccttattcatgttttctatttctttagttactgaaattttctattctttttttttattatactttaagttctggggtacatgtgcagaaggtggaggtttgttacataggtatacatgtgccatggtggtttgctgcacccatcaacagtcatctacattaggtgtttctcctaatgttatccctcccctagccccccaccccccgacaggccccggtgtgatattctcctccctgtgtccaagtgttctcattgttcaactcccacttatgagtgagaacatgtggtgtttggttttctgttcttgcgttagtttgctgagaaagatggtttccagtttcatccatgttcctgcaaaggacatgaactcatcctttcttatggctgcatagtattccatggcgtatatgtgccacattttctttatccagtctatcattgatgggcatttgggttggttccaagtctttgctattgttaacagtgccacaataaacatatgtgtacatgtgtctttatgatagaatgatttataatcctttgggtatatacccagtaatgggattgctgggttaaatagtatttctagtactagatccttgaggatcaccacactgtcttccacaatggttgaactaatttacactcccacccacagtgtaaaagtgttcctatttctccacatcctctccagcatctgttgaggatatttgtatttgcttgttgaagaacttttgttgacaaataattctaacattctgtcatctcagcattgcgcctctttttttttttcttttctttttttttttttttttggtcaatcaagttgtgatttcctgtctcttgctatgacaagagctattttattatatcttgtacattttggctggtatgttgagagactctggatcctagttcagtcttttatttcaacaggcagttacactgtttagcttaaccatgtaaatactgatctaattttctggccaacagttttaatgacagtttaattttgagatactatttttatctgcttaattggcctgattctattaggtcttttgctaatccttcttggtgccaccagtgaggaccaaaagtgcttccccaggcagggttatctccattagctaggctctggaagagcacttttcctggccccttgttttctgtgggttctttcctgattcctgcctcagcattcaggcatcatgggttgctcagtgtctggtgtaagttgtaaaggttggggaactttagtttccaggcacttcccttggcctcttgtaggcaggattccatttcaataaagggaggaagggtcctgcctgagctgctttttcgtactgatttgggaattataagatgcccatgctgtatctctttgtgctggtgtgggagttggagcaagaactggaagatgttgaggcacagtgttttccttcaatcttgcaatccttaaccagtctaccttcctctttccacatctcagagtcctcctatggttgtctgttgtgttatctttaaggtttataattgtacgtagaggagaggaacaaggaatgatgagtctatgccatctcatccagactgcctttcaagggtatctttctttctatagctcaagttcttattactctctaatttaaattattcagttaattcccatcactctcaagtaaaatcaatacttcttaatctgaccttatcaattaggaccctgtgctacatgtaacagaaaccacaatccaaataataattaatgaaacctctatcttggcttatatctgtaaagctcagagtcttcaagggaggcctcatgccaggcttaaaccatatcaccagaatccatcactagtctgctttttctgattggctctctcatagtgtttataaaatatttgccacatttttcttggggtcagcttattcatgttcataccccaaagcaagaaaaatatatgtagaccctaacacatcccacccttacacaccaagcaagaaggctaaatgtcatgggtttcatgaggtaactttctccatatttgaactctaagtatgtggtggggtcagggaaggcatcttcttactcctgtttcctgaagagtgtgtagtagtcaatatttcctgaagcacatgggccgtaaggaagtaaaaattcagttcctgttatttaaagaaagggaaaatgggtccatcaggaccaaaaaaaaaatcctgcaaatgtaattacagtggtttacaagtactgccttcatctctacttgtttgctttgctactttccactcgtccagtgtatctttttgtgctcccaagaaaccattgagaagcactttcagatttttagatgtatcatctttttccaccttgaagactatggtcatgctactctctttgcttgaaacacccaactccattcttcttcagtactatggtttgaatttatccccaaaattcatgtgttggtaacttaatccttaatgcaatagtgttgaggtttttaaagagatgattaagtcatgagggctctgcccttacaaatagattaatgcagttatcaagggataggttagttctcacaggattgggatcctaataaaagggtaagctcagccccttcccttgttcctctttctcctgcatgtgctgtctcacccttcaaccttttgctgtgcaataatgtagcaagaagggcctcaccagatgcaggtcccttggccttggaatttccagcctgtagaactgtaagaaatatttgttctttataaatatttatttatatttataaacagaatacctagtctcaggtattctgttacctcagcaaaagacaaactaagaccaacaactgatactgagtagcgagactgttgttataacaaatacctgaaaatgtggacacagctttggagttgggtaatggctacgggctagaagaatttgaatgagcaagctagaaaaagtctagatcatcatgaatggagtgttaagggcaattctggtgagggcttagaaaaagacaagaactttcaacagcttaccaaccaaaaagagtccaggaccagatggattcacagctgaattctaccagaggtacaaggaggaactggtaccattccttctgaaactattccgatcaatagaaaaagagggaatcctccgtaactcattttgtgaggccagcatcatcctgataccaaagacgggcagagacaaaaccaaaaaagagaattttagaccaatatccttgatgaacattgatgcaaaaatcctcaatgaaatactggcaaaccaaatccagcagcacatcaaaaaacttacccaccatgatcaagtgggcttcatccctgggatgcaaggctggttcaatatacgcaaatcaataaatgtaatccagcatataaacagaaccaatgacaaaaaccacgactatctcaatagatacagaaaaggcctttgacaaaattcaacaacgcttcatgctaaaaactctcaataaattaggtgttgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaaaaacaggcaaacagagagccaaatcatgagtgaactcccattcacaattgcttcaaagagaataaaatacctaggaatccaacttacaagggacgtgaaggacctcttcaaggagaactacaaaccactgctcaatgaagtaaaagaggatacaaacaaatggaagaacattccatgctcgtgggtaggaagaatcaatatcgtgaaaatggccatactgcccaaggtaatttatagcttcaatgccatccctatcaagctaccaatgactttcttcacagaattggaaaaaaccactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgctgcgtatctacaacgatctgatctttgacaaacctgagaaaaacaagcaatggggaaaggattccctatttaataaatggtgctgggaaaactggctagccatatgtagaaagctgaaactggatccctttcttacaccttatacaaaaatgaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaaaggctaatatccagaatctacaatgaactcaaatttacaagaaaaaaacaaacaaccccatcaaaaagtgggcaaaggatatgaacagacacttctcaaaagaagacatttatgcagccaaaagacatatgaaaaaatgctcatcatcactggccatcagagaaatgcaaatcaaaaccacaatgagataccatctcacaccagttagaatggcaatcattaaaaagtcaggaaacaacaggtgctggagaggatatggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgttcatttcatcactattcacaatagcaaagacttggaaccaacccaaatgtccgacaatggtagactggattaagaaaatgtggcacatatacaccatggaatactatgcagccataaaaatgatgagttcatgtcctttgtagagacatggatgaaattggaaatcatcattctcggtaaactatcgcaaggacaaaaaaccaaacaccgcatgttctcactcatagatgggaattgaacaatgagagcacatggacacaggaaggggaacatcacactctgggggctgttgtggggtagggggaagggggagggatagcattaggagatatacctaatgctaaatgacgagttaatgggtgcagcacaccagcatggcacatgtatacatacgtaactaacctgcacattgtgcacgtgtaccctaaaacttaaagtataataataataaaaaaattaaattaaattaaattaaattaaaagaaaaaagaaaaagacaagaactgtagcgagagcctacattttcttaggagttacttaagtggttgagatcagagtattggtagaaatttaaacagtaaaggctactctgacaaggtcttagttgtaaattaggaatagggtattgaaaaatggagtaaataccattctttttataaagttgcaaagaatatggtggaattatgtctgtgtccttggactttgcggaaggcaacactttagagggatgaactaggacatctgtcagaagaaatctttaagcagcaaagtgtttacagagctacgtgacttcttttggttccttatagtaaaatgagagaagagagaaatgattaaagatggaatttgtaattaaaaaggaaacagaatgaaaagatttagaaaactctcagagcctagccaagtaaagcatgtttgagagagaatattaatagtgtgacaaaggtgtttgctaaagagatttatatggctagaaaaacaccaggttctgtttgtcaagacaatgggagaatgatcctaaggcatttcaggtgtgcagaatgcaacagctgtagggccatggcgatctactcctaaatttaaatggatgttgcgaagaacctgtgagccaagacagaggcttgtcacagggatggtgccaccccggagagcctccactgaggaaatgtccagcagagccataggagtgaggccactacataaactccttactctcataatgtttagtggagccatggaagtgaagtagaccctgtgaccccagaactacagagcaaccaatgtgcaactgcatcctgggagagctgcagccataagactctaacccattagtgctgctgggtggactgagccaaacaaaaccctagggacagggcttcatgaggatgtggggtcccactgccttcccattgtgcccagatgtgagacaagagctcaacacagattattgtctagttttaagacatgatatggtttttgttgttgggtttagtactgacttggggcctgtgatttctctttttgtgcctctctctctctcttttaaaatgggaatgtatatcctatgcctgcccccccattgtgttttggaagcatgtaacttttttgatttcataggctcacagatggaggggaatttgcctgaagataaatcacgccttgagtatgacccatatctgatttagatgaggctctggattttgaacttttgaggtgatgctggaaccagttaagactagggtgagataaaaagaatttattttgtgtgtgagaatgacatatgttttccaagccagggggcagcatgctattgtttgaatgtgtcactaaatgcaaaggtgttgagaaaggggacctttaaaaagtgattatgtcataagggctctgctttcacgagtaggttaatgccatcattgcaggagtgggttagttgtcatgggaatgggtttctgataaacagacaccctcctctgtctctcatgtttgtgctgtcttgcccttccaccttccactacggtatgatgcagcaagaaggctctcgctgtatgtgggccccttgaccttcgactttatagcctccagaactgtaataaataaatctctgttctttattacccagtctcaaattttctgttattatcagcacaaaacagactagacatgcagccattttccctctagacacatgcacacacacctatgacctatgtcttgtattgtttcttatgcttctgcattcatttcaatacttgctctgcaactctctcttacactcaaaactaggtgatgccctactgattttacagcctcctttacttctttcaccatcacacttattataccctactgcagtggcctggttttagctgtgtatcccactaacttacaagaaaagaattgtgtcttaatcacaacttgacccttattacctaacaaagagcctcttgagtgatccactttaaaaaactctaggcgatcatatcatgctataagtacatgaagaaaagaacaattataatgtttaggtaaacaaggaggagcctttgtagtaggtgaaccttgaaaaaggagtagaaattttccaggtcttagtttcaagaaggcatttcaggcagtagaaaggtatttcatggagacaggcaagtataagagatataccacctgttaaaatgaaactgaacagatccccgtccccatgggcgttatccatctgtgccttcaaatccatgctgaggctgcttctgcaagcttaagaaattggtattttgcagatccctggagtccacatgacattgtctggccttgtttgttactgctcttttttcagtgtgtaggaatgaagaatgagtgccaataaatctgaatgtcaaaagtcaaatacaaatgtcaaggccattccacatcactggttgttttgaattctgagcccaatttttgcaggctactatggtggggagaaccacttggctatgtctccatttacttatcaaaggctactccaggcataacagacctaggctgcaggcaaatggccttcttatgccatacaagcacagactaactcatcaaatgaaaaagaatagagtttgaaattcctttatgagttttaagaatatttcctgtgagagaaattttgaaagctgctcaattaaaagcaactgtacttcatatattttattttattgtgttgttggcttcatttaggttgaaattagggaatctagcattgttattggtgtttacttttttgagaagtagagcaactcaaattattcagcaggagcagaagggtttggttgatcctatgttgtatttatgccttatatggtattttaagatcttatacaggtaaatagaatcacataaaggtaagaaactaccggagctgtggctcatgcctgtaatcccagcattttgggaggccaaggtgggcagatcacctgaggtcaggagttcgagactagcctcaccaacatggtgaaacaccatctctactaaaaatacaaaaattacctgggcatggtggtgcatgtccgtagtcccagctactcgggaggctgaggcaggagaatcgcttgaacccaggaggaggaggttgcagtgagccaagactgcaccactgcatgccagcctgggtgacagagtgagactccgtctcaaaaaaattaaaaaatgaagaaaaaataatgaaaagagaataaactatctcctttgagaagacaaaggagaaaataagatatattaagctccgagtttgaatcaggaacttaaaaaatatacatatgttattttatttaaccctcactggaagcatgcatatttgcccaatgcctaactttatcaaatgttaatactctgtctcaaaaaaaaaattttttttttaaatcataccctatgtggtcttttgtgcctggcttatttcacttagggtaacgtattaaatattcacctatgtcatattacatattattctttgtattgcaaaataatatcctaatgtatgtatacgctacatatttatcagtttataaacatttgggtcattctcaaatttgtgctatgaacattcatgtacaagttttcatgtgtttatgtttttatttattttgaatatatatactcaaaaggaatagagtgctgggtcatctggcaactccatgtttatcattttgaagaactgtgaagattttacatttccaccagaaatatatgagaattcaattttcttcatattcttaccaacactttttgtcttcttgttattttagtcattataatattcaagaaatggtatctcactagggttttaatttgcattccaataatgtctaatgatgttgaccatcttttcatatgtttgatgaccattttaaaatcttctatggagcaatagctattcaaataatgtgtccatttttaaatgagttctttacatttttattattaaagttgtaagtgttctttatatactcagtggacaagtgtcatattagaaataaaatttgcaaatattttatctcactctatgtatcttctttttatattatttgaagtttattttgcctgatattagtagagctacttgagctctattttggttgatgtttgcatggcatatcatttttctatccttttaccttcaagatatttgatacatataatctgaatctgaagtatatctcttgtagatagcataaagttggatcatttttaagtccattctgctaatatctgccttttattggaatgtttgacacatttacatttaatgtaattgttgacaagtcaggatttacttctgcctctttgctctttgttttcaggcattatgggtctttctttactccctattcttctatcacagccttccttagtattaaatgaatatattaaaataccattttaattcccttttttttttaacgatgtaattttaaattttatttttgtagtggtttccctgtggattacaatgaacattttcacttaaaacaatgtaggaattcaataaacatttttacttaaaacaatctaggattgataacaacttagtttcagtggtagagacaatctttgctcatggatagttccattttctcctccttttgcactgttatcattagcatatgcatatgactttatgcatcataatataatcaatgaagtttttatgtattgcttaatgtagctgccctttaaatcaaatgggaaagaaaggggcttacaaactgtattgtctctaatatttatttatgtagttatctttatgggtaccctgtttcttcatgtgaacttagggtactgtccagtgctttttctatttcttcattttagcctgaaggacaccctttggtatttcttgtagggcaggtctgctattaattaatattctctttatttctctcatagacatacctttacttctccttcagttttgaaggacagtttcgctattggtttttttctttcaacagtttgaatatgtcatcccaccacatcgtggcttctatggtatctaataggaagcctgctactaatctcgttggaaatcatatgcgatgactccttttttcgatacctttacaattctctcattgtatgtgtgttttgacagtttaattatgatgggtctaagttattatgtcttttagtttatcttacttggaggtcattgagcctcttggatgtatgaattaatatttgttaacaaatttggggaattttcagccataatttcttcaagtattctttttgccttattttctttctcatccttctaggacttccattatgcatatgtcagtgtgattgatggtaccacatagtctttttgaggctttgttcccttttatttatctttttttatttctgtttctcaaaccataaaatctcaatttagctatcataaattcactgtttttttccttctgcctgcttaaatctgtttttgaacccctctagtgaacttatttcaattattgcccatttcaatgacacattttatttatttattttaaaaataatttctatataattattaatattctctgtttaaggtattattctcatattttatttaattatttagatatgaagtcctgtagtttgttcaacatattatgatacgttaaagtatgtttaactgacttaaagtttttttttattaacatcaatatatgtatgggcatccttggagagactttaacttactgctgtgctttccttttccccttcctgcccccacatgggtttacttttatgtttctttgtgtatcccataatttttattgaaagctgaacaatttaagtaacgtaatgtgacagctctgaaaatcagattcacctccacttgccaaagctcttatttgattactgatgtttattgctgttttttttttggtttttttttcatttttggtaactttcctggaataattctgtaaagtctgtattccttatcatgtgcagccactgacatctcttttccattaacttagtggtccactgatttctacagagattgccttaaatatcttcatcaagtagaactctcttcctttgccaaatattcacatttgtgctggggcaagccttcagtgctccagcagtttacaactctgtaattaccttcacttcttggtttttcaggattcaagatcagacagaggtgagagagtagggcctgctgggatctttcctacccttgtgcacaactctgttcatgcgtataacattgtgaatccctgggaatatgtagagattttcaaagcccagtaggaaatattattccccatattttcatcttaagctttttgacaagcttcttgtttgccccaacttgctttgctgcctcaggcatcagccacgttaaacaattgctgctgattgcttcaacaaactctcttatgatagggctttcctccctgaatgagctttaagtcaggtcagataaagtttaaaaaagtgacagttcttcagtttggaacttctgaagatctccaaactctacctcttccagtgtttagtggacttctagtttttactgcttttatggctgctagattgttaaattttaaagttcacacagagctggggaaagggggatggaaatagagcttaaaatgatacaaagcttgctggttttgttgttgtcatttttaccaaggttctgccttttttcttctataaacactccttagattgttacaagcctttggtttatttctagagttcttaaaaaaagttgattttttttacaaatgttacctatctttcattgattttatggagagacagatgtttggagggacttactttatcatctggaagtaattagatgtttggagggacttactttatcatctggaagtactcttcttcattgataggtcttaaaagttttggcatttcagtacaacatagatttatgtgaatttatctttcattattctgctgggtactcaaagggaattttaatttgtatctttaattctgaaaaattttcaccagttttatcttcaattattacgtctttgttattccttctgttcaagactttgagtcttattttgtttcctgttggagcttttaatctattcttcatctctattaggtgttatttcaatgttttttgtcttggtcttgctactgcattctgagttaaattttaaatattgtcttccagtttaacaaactcttctatattgtgactagtttttgaaatttttaggatgatttaattatttttttattttaattgagggtttttatttatttatttatttttttgacggagttttgctcttgtagcccaggctggagtgcaatggcatgccctcagctcaccgcaacctccacctcctgagttcaagccattctcctgcctcagcctcctgagtagctgggattttagacatgtgccacaacgcccagctaattttttgtatttttagtagagatggggtttctccatgttgtttaggctggtccgaactcccaacctcaggtgatccgcccacctcggcgtcccaaagtgctgggattacaggcataagccaccacagaggttttttgtttgtttgtttttttaatcctaccaataaactcagagttttcttctctctctttttttatttttaacaatctcttgggttttttattttggtttttgaaaatgaagatttaaaaaaaatttctctcctgaaacattcgtctgtaagttttaaaatgttgatcattccatctggagtaattcttctgtgtattgtttgtgatggttgtaattttaacattaaatttcacatgaattttggaatttggatttgctggctcatttttgagtgggagtttgttgtgtttcattttacttttcctctctgtttatgcttacttttttctccctaccatttcttggctcacattaaataatgaatcactataatgtaattggacgtatctgtgctgagacagtattagggagagggtagatatggtcacccagtcaggaagcatcttattgtctcattttaagtctctggctgtcatctccctaggcctgcagctaccaggaactagaaatctgaaaagtgttcagtgacatctctctacccccttatttattctggggagatttaaaacttaagccttctcagatccaggtgtcattcagaataaggttatgttgcaatagcttataaccctaacatctctgtggcattaaaaaacaacaacgaagtttcatttctcactaatctttaatgtctgttgtgggtcctgtggctatgtcttatcatcacttttattctgtgactgagatagatgagattgtctcttcctggatcaaaagcatatgggaaaactgatcagtggcttctaaagcttcttccacaaggcatcatatcatttttgctcacattccatagactcgaacaagtcatgaggccaagcctaacattaataccacaataaagtagattctgccccactagagggttaatattttatattaaagtataatatggtctaccaaattctctttcacttattttttttacctgtaatagtgtaacctttagctaccactgtctgctttgattccctcaaactgcctgaactattgcttcagctgtgaacaacactttctatttctattctattctgtgtacttgttttcttgattttagcccaattatctctctgattttctatttttctctttgtgtctcattgttctatgtttggagcataggaaggtgcctcagataataaattaaatatcctatctcattcataatggcatcaattttttttggtggaagaaaaacaaacttcacaaatccataattaaatctcctctctctcccacaaatcaccttttggaatcagttttagtatcagactagggaaccaacatcctctgtgtctggtatgagatgcaatctttatatttctttaaggttttggtgttaattgatccagtagaatttttatgtaaccaaaatttattccttggcctgaaatgttctctaattagttactataaactggtgcttattcagccgagctgtgcaattttgggacttttgggttaataaaagcctaatctgctcatttgtttacactgtttactccctaaaggcttatgctttgtgactgaaaacaatgcttaataagcagaagaaagcatgttaattgtaggcactgccatgctgctgtgtacctaagagctgggcttggctgcagctcaaacaggtcttgggtagaactaaccaagttgccctcaagcttaacttccaattgtcacaaaattcatcttgggcttagagatgaattttaaatacatcgaagagtaaaatgctctgttaccagagtgggtcagtggagctcagctaccatcgatctacactctaactctcttcctccatcaacctttacatcctctaatggaggaatgtctcccatatgaaatagtggccactcacccaaatgtaatattggtgacagacaaagggaaactaagctctaacctctctccccaccaaaagttcacatttcttcagtcaaatcatcatgtggacagaaatcaatttcttctctatgctgtcactgagaaagagggaatatataaaactcacgtataaaaatacagaagtaaaatgaagatctctatgttaagtgagtactatccagaataattgatttccattactggatatcttcaaataaatgattgatggtaatttgatatcacaaaagagaaagcagtattttttataaaaaagctttattggtataacagaggtataatgacattttttaaaaagttacacatgtaatgtatataaccttaatgagtctggacacttgtgatactgttaccacaaccaaggtgtgaaacatatcatcaagaccacagtttttgtgtatgtgtgcacattcatgacaggatatgtgttacagagctaatgtctttattttaaaaagctttattcatttggattttattccttactattatattctttattcaacagttgtctttccatctcatctctcctgattcttccccatgctttaaaaaatgttaatgtcttcttgagactgtcaaaaacaacattacaacaaatttctttatagatctaattggcttttataggtgatacatgaatcagggcagccttcattctacaaaactgaacaagtgttcttctgggcaggggcaaaacactgggttttgaaaggtgaaaagtaggaaatagaaaaatggaaatctagtaagcatcatattacctcaggttactttttttaaaggggtaaagcagaagagacttccttattaggattactgaggtaaactggaatctcttgttttcaggaaagattgttttgtttggggatctatctgctttcttaaattttcattttaattatgtggcatttagcatgagtgactccattttggtttggtctggtcgtttagggcctagtgcaggagttcagtctgaaacaatggcctcccataatcttgtttaacaattctaaaagaaggtcgttcctttaactctattcctctctgtggtttcatccctctcctttaccaatcgattcatatttacttttgtatgttctcaaaggcaagttaaataatactgcatactgaagtctgttcagtgtccccacaatcataataaaatgtctaagacagacttatgagcttctcaaactgtgttgtgggtgtacttttaggctcatgtgagatcatgaatatggtgcattctcctgaagtatcaattttactcagtactgaaaacattattctatcattaaaacaaacacaactagattagagagtatattgcaaaatctccatgaacttaatactaaaataagagtctgaaagccgactggtaccccagattgtcaatcagctcctattggaagcctgtcaagtccaccatagagcagcagccaaaccatttcatgggagagaacgaggactctgcagcgaagtctgaaagtgctgcagccctctggaccctgtggactctcaaaactaatcaaatggaatgtccatccaagacaaagccccgcaccaatgtgaaattgttgagagaaaaccaaaatttatcaaatagctacaatagaagcaaaggaaataaagtggtaaagagagagagagggggaggcaaagaaaaggaggaacaaaagcagcattaccacagtgaatgtgaattttaaaattattttctcatttattattttgcaaaaatgacaggagagggagccctagagccataatgctagaaaactatcctgacccttcctctttcctaaaagtacaaagaaactccaaagaagaaaagaggagaaagatgaggaggaggaggaagagaggagaggaataggggtaaaaataaatcttggtcaactcttatacaaacttattataaattcttacagggaaggagaatgaaaacagaatgatgcagacaaggaaattatgccataaagctagtcccaaaacaaatgaaaactacaacctaatattttttaaaaatagctaaaataagaagctatgaaaaaaagatgtataccagaattagaaaaactctgaaaagaggcaattagaaaaattaagatctaaaaagagaagtaacaggacaaatttagaaatgaaaatgaacctttttacaatcagtcttcatttttactccattgcgttcgacactgttgttctgaaagtctttcctgctctggactctggaagatgttagtccttctaattctcctgcagctactgcttcctgctctaattcatggctcttcatcactgccatagaaatgggacgtttcctatggctctctctgggccacatctttcagttaacttggcccagtggctgcaacaacttttaaagtttataaataactttaaatatggctgcatttcaaataaacccctcacttcttgacctgctccatacttgactatccaggtgcctttgggatgtctcactggcatttcaggtgggtcatgtccaaagtcacctactcagtgcttaaatctacctctcatatacaatttcataatttggaaaacaatgttttttttctgtcactcagattcaaaactccagaagcatccatcactgctttcttctttgtcatgttcattatatcaaatgtccttgtttgctcatgtctgcccccaaagtacctcgaatctgttctctcctttaactcttcactgccactccctcaacaccactctctacttgcaataaataactgttttttgccttctctgacttcattttgtctcatctgctagtgatgttgtcaaactgatctcaattggtagatcggagttgtcttctaggggagtttatgaatgtaaacaaaactgtgaatgtggcctcctgaagttgcatatttgacctggctctgtcttcttcagggcaacagattctcaacctggttttgttgttagtacagttgaaagaattaattttaagaaaaacaagtcagaagaaattacagtgcagtaactagtaaaataatcatgactacattaaaatatttttaaatacccttaaaatggttcaaggtattatcctctagaagtgtattgctatttattgccttttcaatactcttttgtatacctgaggcaatgtctttgagaacctacttgaaaaaaagtgtaacactgttttcctcttactcacagtaccttgtaccctgatatttgtaacatcacaaaacccacagagttaggggctgaccaaatatacacagtaagttatagtattgggtaaatgaaacaatcctgcaacaaaagattcttcagttccaatacagaagaataaaggaaacacaatttaattttgagaaagcattaccaggttgacatgtatataaggtggcacacaagaaactataaactctggacagaatcttacacaaatctatacagcagtcaaagaaagaacaatagaaacttctcttatctccttgagagataaatagatgagccctgtcatctgctctatagttgtgagatagcacagagctaatttgtaggtttacagttccaaggggaagaaggccagaaaactgaatcaaaaggactatcttgtttgggggtttattaagtttacaaggaaacaccccaaaggaaaaaagcgtgagtatgaagccacttctctcctcaaagaaaattttataatttatttttacagttgcaactacaatcacttgtaaagacaaatcccagattccttagaaactagaagcatagtaatgaagagttctcgaaacatctgcaagctactgtgtataaatggaaaatcactgggctatagagagacggtcagattttttgtgtgtggaatttttaatgcattttgtaatctcacatcaacttgatttttactcacatttcccactcctacatccttatctcggaccccttgggatatagagaaggactggctgggctggagtcagttggaatgcagacagtggtaggtcacacagaggctctgcaggtgactgggagatactcaaggttcataggataattggatgtcagtcattctgatagtggaattcaatgatatagaagaggattatttagacaatatgtagtcaagcagtctgccaataatttattgagtacctgctatatgccaggggctagataatttccaagaacagagtatatcagcatgatagagttctaacaaaagatgctgagacttattggtgcggctgtatatctggagaagagctccggtgtctagaaaatgagagaggtaaagagattttaccctaggctgggtgcggtggctcacacctgtaatcctagcactttgagaggccaaggcgggcggatcaccgaagtcaggagttcaaaccagcctggccaatgcggtgaaaccccatctctactaaaaatacaaaaactagctgggcatgttggcttgtaccagtaatcccagctactcaggaggctgaggcaggagagtcacttgaaccggggagtcagaggttgcagtgaggtgagattgcgccattgcactccagcctgggtgacaagagcgaaattccgtctcaaaaaaaaaaaaaaaagacatttcagtctaacgtaaaggaaatctctctagaaactggagtattatgtaagagatggtcttttgagaaatacaggcagaagccatgtagcatttgttgacaacactgatgggggattcgtgcaccaggcccaatggtgaactctagaatctctaggtctctagggttccttctaattcaagaagccaagtgagacactgtagcagacagtgtctccaggcagggtactgagcaaagaggatagtgaaaagggcagtgaaacatcggcctttttcactggcaacttcaagactcactgcctacaatgtaagtattcctcgtattccctaacaacagttcaactggaagagtggtttctgtgaatccctttgactttttatcttgccttggtcctggctccatggaggtccactgtccaagaatagaagagctggacccgccatgatacacccttcgtcatgttggccatgtctggataggtcccttgacttcagtgtctttcttaaggttcctgcctttggttctctttgcttcctctttggatttatagccggtttctgactctcttgtgcttgaatcttatttctcggttttctgtctctatcgccttctagactattacttgtgatttaaaaaactatatttgctagctatctgaaaatcaagttaacattagcaaaatgttttagcaatgctctgggtttctacatctttacttttctgcggaaggtgagagacatcttacatttggttaggatatttcttagtttcccttgtgatttttggttttaacaaatgagcaagccccagggtgattattataacaattatttttacctacgggcaagaaagggaaacatattcaaccactaacattgacttagctttatttttaagcatcccaatcattagcaccattcattcatttaacaaatattgaactctgttttacagtaatttactgtgctgaatgttatagggaatgagagtgtgcatattacatgttaatgatattgcctagcatttagtaggtgcttaattaatgttagtacatttggctgttgatgatgacaaaaatgatgaaagtggcatacatagtattaatgaagtctattttctgtattataatatttggaagttataggagattagcaaacaagctgcaaagtaccaaataagatatattaaagcaagagttcagtctcaaatgctagtgaaggaggcatttctaaatgtgactaggagtctcccaatttgaattttcacttcccttaaggtgacctgagcagaatccaaatcctttgacttgatgtgggtggacagctggtgcacagaggagctaggggcacaattgagctggaaaggctgttaactgaagtatcctaagactgcctaattaaggggaagagatctggggagctggaaggtgggaaagaattgaattcttctttatcaaagggcaaaggcaaggttatgaaagtaaatgagtattgtgttcagatagagaaatagtggtatagtgaatgcagcaaagatacttcaaatgactgagtcctgggaaaaggagcatgtgatggaacatgcctattaggcagactagtgtgttccgctagagaaaagttgcacttcgaagatgtggccactgtctggaggtacatattttaaaccactgtatccatatcagtccaaccaccatgtttaatctcaggaatctggagagatttatccatggtatcgggatcagtaagcactggaaattaagagcgtaagactgaagtaactatgaaaacttatagttgaagtggtcactccatcagcttccttatgtgttggcaagatagtgttagaaaaacatctttctttttctttctgtcttcaaaaaatgagctgacacattccatctggaatgtgtcattaaggccagtagcagattgccaagccctccaacaatgaattacagccatcaagctgtggcattggagaagtaagggttaatcattgtgtcattggtatccacagagttcataattttggactttgtgcaaatggaaaattgtaatcttcagctgccttttgccaggctacagaatggcagcagagtccaatgtgatagacatattagtggtaaaaagcctgtttacctggtgcaaacagggcttatctttcaagacactatttgaagagtacgcagaatttcttgggagaggaatattctggaggatggatatattcacttgcccctgtggcatttgttttctccttgtaatgtctgtgtgatgtgatggtaaattcagaatatctgttccaatagacacattcaatgtaacactcaacatgatccattgctatcccatgctttgctttcttcgggttcctttaaattaccaaagtctcttgtatgtgagctgctttgaccagttttcattttaggaatgagaggaaagcatctcttaccaaaaaagtaggaaaattccaccattagttacccatttaatttgtttcaaatagcatgtgaaaaacagcagtcatctaggtaaaagaatgggctgaatccactagaggtgcgtagtatgagttttttaaccaaattcctttactctaatacttttgtgagatcagatatagttaaagaatgtttgattgggtgctaggaaagtgagagaaaacagagctcattcacgacagagagaggaggccctggtgtgttgccacaaatgagtagcatcttggataaatgcaaatgtctggaagtcaggggagagtggatattagcagaaaatgaatgtgcaaaagggtttgaaatatttcaaactttataaatcagcttgaggctactctgcatgatctaacttttttgaaaacaaacatgctgatcaagggggtcaaattggtgagctcaggtttaatggactaaaactgagaaactaaaaattacagcaactgccaagaaccttgcatatccttatcagtttatgatatttactcagatatattgatttcaagacaaaaatatatctttcaaattgtgtctacataaaatatcagggttaatgtagaagaacaggacaacccatggagtagtactatttaccaggccctttatttttattttttttaaattttttgagacaagatctcgctctgtcacccaggctggagtgcagtggcctgatcacggctcactgaagctttgatctcctgggctccaaccatctgccccactcagcctcctaagtagctgggactacaggcacgcaccaccaagcccagctaattttcggtttttgattatttttgttttgtttttatggtagggacaaggctttgccattttgcccaggctggtctcaaaatcctgggctcaaatgattcacctgtcttggctcccagagtgttgggattacagatgtaaacatcgcacccagcctccctaggttccttattttgtgattgtgttgaatgtttactacaatcctctgaactaacacaaagattttatgatgtagaaaattctggtttaaagagtatcaaagaaaccgtctgaggctatgtgaatcttaagggaggaattttgcattcagaactctgtgaggactccagacccctatacttcctgtagatgatcctcccctccagtaaaggcacctgtgttgaatgagtgcagaccattcaagggattcggttgtagtatgacaggggcagtagaaaactttatctgtggatgtgagagtcggtttagaagtttattttggaaatgtgtggtcaatattcttttaaattgcctgtaaatgtttctgcgcttatttgtgtgggactctaaatgacagaatagatagggaaatctagttacccatctatctcctaataaatcattgaagacaattgcatcaacagaagtatgtgtatttcatctttgctgaagggcacatttaaaaaaatgttagttcaataatctcatttgtaaatctcagaaatcttgtgatgtataatttttcaccttaaagagtttctttttctttcattcattcatttttttgactttatgagagaatcagaatctctttgacatcatttgcagaacattgcagatgaataaaagggtggtgattgagttattccggtgttgaggaaagagtgtgggctttcaagtcagacatgcccatgatgaagcgtaaatatgtattttgagttataaaatgaagacaacaatacttctcacaggatcgtggggaaaattaaatgagataatggctacaaaaaatatttagctcaataatttgaacacacgaagtagtccctccttatccatggcttcactttacggttttagttccccaaggtcaaccatagtccaaaaatattaagtggacagttccaggcataaacaatttataagttttaaattgtgtactgttctgaatactgtgatgaaatttcacaccattatgctttgtccctttgtccagcacatccgcgccatccgtgctcccagcccaccagtcacttagtagctgtttcacttatcagatcaaccatcacagtggcactgtgctagtgtccaagtaacccttgttttacttaatggccccaaagtgcaagagtggtgatgctgtcaatttgcacccgccaaagagaaactgcaaagtgcttcctttaagtgaaaaggtgaaacttctggacttaataaggaaagaaaaaattatatgctgacattgctaagatctatggtaagaatgaatcttctaagtgaaattctgaagaaggcaaaagaaattcatgctaattttgctgtcacacatcaagctgcaaaggttttggctacaatgcatgataagggcttaattaagatggaaaaggcattgcatttgtgggtggaagacatgaacagaaatgtatttcgaacgacagcaatcaggttcagtactgttcgtggtttctggcatccacagggggtcgaggataaaagggggccactatagtaagtgctcaataaatgctagccacaaaatcattatcattcttattgctataatcacacatgagaaaatcaattatcttcttcaggccttggattccaatcttgtaaagtgaggtttaaatgagaatgcatatgtgaagcatttgccttacaacacaaagccttaataagtgccagtgactcttctccatccgttttcatccagacaccactttcttgccaactaactgccctttgctaggcttgagaatgcagacggtcaaaattgacgctattttcagagccacagaatttcaacatagcctatctgggaaggtacacattctcaaatttaccttccctgactacagaagttaccaaatgtggaaactttgatccatactttatctaattagataccaattagctttctgctataagaaatgtactactggggttagtactactgggggttagagcatcccaagtatattgaagccaatcatgtaattttcatcagcttttcttagaactcatttttagtcagtgctattcaaatgtattatgcacacaaatcccctgatgaacctgtgacaaatgaaggttttgtttcacaaggttggggaagaggctggaggttctgaatttctaaggtctcagttgatggcaatgctgcaagaccatccctttgagtggttagagtcttgggtccttgctaatattgtggtaggtaatgagccctcaccctagttagactgcagctttcaccagcagataccatcggacattcctttgatcgtatatcttccactatcagctttgtgtctcattttttcagcatactttcatttaaacgtgaatgcacttagagtaaaaccactcactgctcctcaaataattccctttaatcttgtctctgcgtcttttgtccctgtgtctttcttttatttatttatttatatttttctttttagtacccttcccctttgtcagctttgcaaaatccttccagaccctgtttaaatctttcctcctccgtttagaaactggcttgaaggggagaggtgtcattgccagatcttgaggccctgggaggaaatctgctggaaggtggggaggtgtatggaggatggaagcagacacatgagttaagaggctgatgtattagagcatgaaagaggtgacgtggtcttgaatctgggatgatctccaaggagatgttcctgatgagcttatgacttgggcaaattggctaagcaacctgagcctctgggcctttgtaaaattgcagagatggtcctatagtctctaaattatctttcagattaaatattctgaatttggtgggctgtaagcaaatgtgcacaggcctgttccaaagacttcttagtttggatcagtacattttagtatgtcacttctattgctaaaaatctttattttcaaatttttctgtcaaaggtttttctgaaacatcaactgagaatgaggggaaaatgttgctttaggagattttatctaatcttattaatagcaaattgtatagagatttcttatgaacatttaagaaatagaattcattcatcctaatctactgctagagaagcatttgtttatagagagactgggtcctttcatatcagaaagcaagtgacacctcagggaaacatcagctatggctttaagcagatgtgagtgtcaacaaggtttgagttcctcatgtgccttattgacacttcctgttataaatatgacttataggtcttttcaacaatgacaatgacaattgaggcctgaaattatgcccgattgtctgaatacttagataagacggcattattttctatatattttatttgtgatcaagttctgtgattgcctttctacttagtttttgctgtttttataaaaatatatactaaagacaaaaatcctgacctcattcacacatcacgtattagtagagcatgtatgaggtattgggtaatgagctaggcttctactcacggacctacaattaatgtgagaagtgaagctaaagacccaacctgatgattagttgagacttttcaagtatttctctctagaaaaggcattgatttgaggatgttgtttcacatttctgagatgcatctaggagttgtcatgtaccattagtatataaatccggagtggctaatcaggagggaaaaagagaataatttaggagtgacaaccagatacgtagagaagatgatgtagatgacagtctgatgggggtactggaattagtgcatagtacttaggtaagtctcatgtgttcctctgcagtttggatcataaggttgtctgatagagcctgttgtagacatcagataggcaccatctgcatgtaacccttcctatttctatttgtcctacctgcaaatcattttatttttgaagcacatctactcattgtctacatagactttaaagactcacactatattttatttcaactgtttcctgctttcatgtgatggaattacagctttccacacattgtttgctgccaagaccctaattggttattggacataaatgtcctgggagaaagtcaccatcccaacatgagttttagcctcttgcttttccaaatgtttgcaatatctttccaacaatttctttccctctaatcatgttctgcttctaaatgagacatctgtcaaagtacataaaaagacaaatgttataaaagtgaaatgatatctaatttttgacttatttagggggcatcttgacttacatgttttcattacacttgaaatataataattactgcatgttcaataacatcaatttgagcaagtaaacttgcaaggactcaataaggggaactgacagtcatgaatacctactttgtgtctggggatttgctaacattatttcattaccttgcaacggggtgtgtggagtgttgctactcatgtccacctatgtaaagttcagaggcctccatgagtccagaatacataattacatgaatcagagttaggatgtgaacacacatccataggactacaatgtaatttcctttcttgttggaatttaaagtgtgatccaaggccagcaacatcagcatcatctgggagcttgttagatacacagaatctcaagtgccaccccaaagcaaactgcttcagaatctttgttttattaataataagctcccttgatgaatcctatgcacattcaagagtgagaaatactgatttatacatcatgcctccaaagcaagcttctttttccctttttccctgtttcctgtcttctcttatatggctgcaaagacagtcatatggcatactttttaaataaatttatttcatttattttttcacaaaacacatctaattttctttgaaacagtccagggactcacagtactattccttgtttacaaatcctttttctttctttacctaaatagtctcctctcacagacaatttctttccttcttcatctttctcaataactgcaaaaattttctccaataaattgactcccattatcgtaagggggtagatgtatctggtgttaccctttctgtgttgtgaatgaggaacatttatggttaattcgtaggttcttcacttattttcatctcatttttcatgtatcttgaataattgctctcataaatgcccctcaaacataatttctacacacgtagtaaaaaaaaaaaagcacagtagtcaagtcgctattttgaataagcaccttagagtttctcctttcattttgtttatagcttataaatacagtttctacttacactgtgtatcacacagttaaatctgaatgatacattgagatcattttactaaatgttccagaaaataaatattcaaattcatttaaattcaataaaggagtcgactcatttcattttactattacaaattacttataatttttggtgatcagtgacattatgtaattaaacacacacatttttcttttaattttgagatatttttatgataatataaatgtgtgagatctttcatagatgattatatatgtgattaacttttttagatagccttagaatgaaaaaaatctctccaattaaactgttattttttagaaatacttcattagctttttctgcaatgacaaaacttttacctatttatgattaatagaattacccatgcttcatgttttaaatcaaacccggaatttagacaactaaagtaatctcaaaattatgaatttattccttatacagctacttatttattgttttttcacctgtcctgggataagatgataaaacaatatatggctcctgccataatattatgattaaacccacatataaacactaaaattacgtgaatttttactaaaattgcatgaattacatgtattggggtcagtgctacagtgttgtctgttcacagtagaggtgctatttggcttgagccttgaggaataatggcagatcaatgggtttagtactgaaggcaaagaaatgaggaatgctggcatatgctgtagcagtgactgagaggaggcgatggtgggatatgaagttggacaagagggtcaaggccagttcaagacaacacatgcaccatgcaaagaagggaacagccatgagaagccattaaagagccccatcccatattatccaatatatatttagtactcgccatttgccaatgattgtgctagtgactgtgtatgcaattcagttgtgtatgtaaaggagaaaaaaaatgatgagtctcagggcatattaaacaaagtagaagatatgggatttgaaccaaagatccactgttttcaacactcattcttcttctttataatcataaaatatatcatttatacaaaaaatatatattatatttataaaatgtgaaaaaaacaacattagtattcccatgtaccccatttaaaaaatgtgaacataataacaccattgagacaagtcctgtgctcctctgagatgtaaattatcttccttagcattcctaagtttgtaactatgtccccataatatattatatcttatcatacagaaacgtatttaaatagttttaacacataatgtatattttggtgatttttaagaaattcaaccttatgtttgtgagatttgtccctgttaacgtggctgtagagaatttactttcagggttcatttgtgtttcaacctcatttcttgtttctagatttttgctttactatcaatgacactagagaatttttatgtaagaaatattcatctttaattctgcaagagataatcctaagtagttttccaggtttttttcagtgatttacacccccattctcacaatctgctttccatgaccttgtcaataaaacttcattattttttttaaatttaagataatctactgggttgtaaaggcatttcaataatccaatttctacacaggtttttttttttcttataacttgttgatttttatatttctgctcttgtgaaagccaactcctgatttgaaagttgctttttcttattgatatatataggataggtattttttacatattctggatactaattcctttggcaattatgtgtcttgtaaattacctcccagtttatggcttgccctatgattttgacaggcagaggttcttaattgtagtacagttaaagatatcagcccatcctaattctttgtgtgcttcatgtcttgtttaaaagtagccctaccctaaggttatggatatgtattggtctatttcctttgaaaagttttaaagatctggtttttatacttaagtataaaatccatttgggattgacagttgtgaatgatttagcagtggatctccaatgctgtttttttctatgtgaatgtttttgaagagttttaggctgagatgttgcactaggttcatttttgcttaaaatggactggattagtatgtgactaaagacaaacagatcagtaaagaagtgactgaaggccaggcactgtggctcacgcctgtaatcccagcactttgggaggccgaggcaggtggatcacctgatgtcaggagtttgagaccagcctggccaacgtggtgaaaccccgtctctactaaaaatacaaaaattagccaggcgtgctggtgggtgcctgtaatcccagcaactcgggaggcggaggcaggagaatcacttgaacccgggagacggaagttgtggtgagccaagatcgcaccactgcactccagcctaaaaaaaaaaaaaaaaaaaagaagaagcgactgcaatagtccaagccagtgatgctgagggtgtgaactaggtcgctggtaataggaagaatagggagacatacaagatattaatacttaaaagccactaaaaacaggatttgttatctaattttaatgggtatgtcatacatttttctctttaaattcttatgaattttcagaataaaatatactactgccctactatggagaggtgtccttgtgtgtcctttacttgcagtgttcttcctttagtcatttgcagggccccttccttcacttccttcaaatctccactgaaattcactttttcactgggggctcctttgagcctcctttgcaaaatagccatatctgtctcccaagcatatatacatacaaacgcctggcaatgaatgcctgcctagctctttaccatgatatgtattgcttcatatgacttataaccatcttcacatgatttgttttgtaatgtttatattttcactagataacaaactctatgaaggaagaagcttcacctgtttgttcactgccatatcaccagagcctacttctgtatccattaaatattcgttgaataaacaaaagggcagaaagaacttgtatgtcaatgatgtgcgttccctttttagaaagggaggcttgtggcgaccttctaaagtttttggaattttaaccagcttttgtttctcctgcaatggtgaaattctggggagatatcagtgacccatttggcttagagctaccttcctattagattctattgtaacacttgtggaacaggtgaaaagtaaaggtgacaggcagtaggaaccattgggaatacaccaatttgggctgcacatgccgaggttagtccattcatcatctttattccacattgacagtaaaagcaatgatctctaaattaattagatccttagagataaagcaaaataaaactgtgaacattaataggcccgtatttcaacacctgcctggactgaggcaagctcttcctgttcaattgctttccttccctgccatggagctgcattcaccagcagtcctccagggggcaggctttgaaattttcagagttggattgcccagtctgtcttaatccatacttcagggaagaaaccatgatagttgactgaataaacatgtaaaacaccttgtagactggatcctacaatctttggtcacaccagagcttggcaagcatgttgtcttcaagccacactttagagacagaaacttaaagagatgtcagctggcttcagtgttggtatgaagcctgatagctcagctgagttaaatgactcccaacaaccaaatacatggctcttctagaccagggtttctcaaatgttaatatgtatataattatgtggagatcttgttgaaatgtaggttccagttcgctatgtctgtgtgggaatctaagatcctctatttctcccagtctcctctcagttgatgctgatattcctagtccctgaatcatcctttgagaagcaaggcacctagatttctggtcaaaatgctgaaaattaacaacccaaatttaaagatatgtggtttgttttgcttttttgttttgtttttctttgaggcaaattactagaaccaaccaaccaatgaaggttcttcggctcaagaacaaaaagtctactttgaaatttacattttgacatgaagcaaaataaaatgttaagcctagttatttttcatttaatcctaggtgagataaaaaataatactgcttctattaaactgacataattatagtaaaatgtgggtgaaataaaaataagatctttattgtatatggaaaatgtagaatcaacactgctaaaaaccacatcaataaaacaaaaaatgaatttaaaaagcacactcaggatgcaaaagcaacctctcaggagataaaaattagcataagagttatgaatgaaacaaaactcaggaccatagaaatattgagaaacctggcttatcacactcaaataaaattactcagtagaaactaacatgtagacattttctgataagttttgaaactgcaaagcaaaagttagatgttttattctacatagtacaaaaaatatgtttatttcaaagaagataaccagacaaaatttgaatttctcctctgcaatagtcaaaaccagaaagcaaaaagaaacatctataaaagtgttagaaaaatcaaatgtgaaccaagattttacatcttgacatgttgtccttaaatgtaatagcaacagaaagacattttcagtcatgcaataactcaagaaatttatcagcaggtatcaatctttgaaacctgtgctcatatcactcatggcagaccacagcatgtcctagatctgaaatgtatgagtgttttgatgagttaatcaagttaaagtaaaaaaaacacaaagtacattattcatcattattcataccctctgtttctcttttttttttttttttttttgagacagggtcttgctctgttgcccaggctggagtatagtggcaaaatcttagctcactgcaacctcttcctcccaggctcaagtgattctcctgcctcagcctcctgagtagctgggattacaggcatccaccaccacacctggctaatttttgtatttttaatagaaatgaggtttcaccatgttggccaagctggtctcaaactcctgacctcaagtgatccacccgcctcagcctcccaaagtggtgggattacagatgtgagccaccgtgcccagcctgtacctttttaaataagtcttagtatattgcattataacattgtagttgcttccatatgagacttcctcgagagcatggtaatcttgagaacaaagatctttatttacacttttacacctttatttgtattatcaacaatatgctcagaaaatgcttattaattaaacgggctgtcttttgtaacacagtctcatttatattcattctcttaactcctagatctgatcacgtttcagaattttgtggtggagaccataaaaatcattgacaaatcaaatttagagattgtatattgaagcgatctttccaaacccaattttaatttttaaagtaactgagggcccaaagctgtgtctgaagcatgacttggaacgtgtgtacacacaggtcttgagaggactatgggaaacagcagctggcctggcgcgtgactcctcagtcccagattcatagagcatcagggctgctacttagaagttactcgtactctgtgcaggtggcacggttcactcccaggaatgctcttcttttcattgctaatcattgttcaccattatctttgcaggctttatcaggatctcctttgatgtaatttgtagtataattgaattgcagcagatgaaagcatttcctcccaagctctatgactcataaccaagtggttttcaattatgtcagcatgtagctttccaaacaggtcttttcattgaccactatttgtatacactattgagttaactttggcaaacataccaattcatagactactgtggattctaattaaactgagatggagaaagataaaatgatcattaatttacattaaagagtagaacagggtgtttagagatttgcctaggattaattttataaataatattaatcactatcattactagtaaatgctaatgcacattctaaaacccagaggccgcatggggcttctccccgaagactaccactgatgaggaagcctgtggagccaggtttatgatatgggaaatttcttgatcctagtgttaaataatttagtattctctcatcctcccatgatgcctctatagtagaaaggccgacagctacttctgacccatgagaaaacatttcatcctgtaaagcctaagagagaattattttttgagttttaggaccaagaagtcagaattttactcttttattttcattttataataaccaacaatttcacatgtattttctgtataatttaaaaagcacttttataaatatcatcttacttcattctcagcactaagcctgtatgagtcatagtgaacacttgcacactatcatgtttggtagtctgctaagcactttatgtgagaggcctcctttaatcctcacaactctgtgttgtgccacctgagactgtatccattttacagagaaggaaagtgcagtacagaaagtttgcatagacttctagagatcacagagctactcagtactggagcaaaagtccaaacccaccatgctgatctgcttctagaaaaatgttctcatgattgttgctctgagagtgtgcattgcggtcatcgccgtcctcctggtttaaagaagtatcttccaaaacccatgttagtaagaggttggctttggtcataccatcctaggaaataattttttaaaatttgctatggcatcctgatgaaagtttgttgtgccttctccagagtttccataaaatgtccaggtactttttgctttcattttctgttccagttaaactcaggacctcccttgcatctcacctggaacaactgctctttactctttggcccaaatgtgagacctggccccatttcattgatttccccaccatttgtcaaagaaatagcaaagctttggggaaatgtatgaggtgttcacttaaaagcttacaacaaacatcatgagaggtttgacacttttgtttctttaaattttttgtgtctactacctaaatttcctcaaaaattttctcttcctgatctttctcttgagctctctgctttcccccatgtggctagaacccttctttttcctctcctgatgtcatgaacttataaattccctttggtctggaaatctcaatattctcattgtaacatgtgtatatgtcatgggatcctccaggtgtcacttcacctggaggttcacagaggtttcagctggaaacctctgtgtccggttgtgccttctgcctaagtattgctcacacctgctgggcttattccgcccacttcacctggcaggctgcactcggctcatgctactggcctggatcccacacctgctaagggtgagccaggggtgcagcagtgaggggtgtgtgggcaagcaagcacggagaccagccactgtgcactggctaggcatgctggctgctatggcagggcaggcagctccaggcgctagcacacgttttggctctgtgtgaagctgtggctggaccacatgtggtacatgtggcatggctgaatggtataattgggcatctgcatctggacgagaggaacatggtgttgcccagaagcttggagacaccaggaaccacagagccccaaaaagggtgtcacagccctggcttagggatcccctatgtctgggctccctgaacggccacagctcttctctccttcttgtcacccacaatgtggcaagtgggaggtgaggtgtttcagccatgttttttgttacagctcttctagtcctgccatttggcgtatcccgagttcttgtcccacatccaggacgaatgaggtatgcagacaactggagggtgatcaaggcaaagaggagcttcattgagcaacagaacagctctcaggagacccgaagtgggtagctcctttccgcaggcaggtcatcccgatgagtgtccagctctcagcagagaggagacccaaagtgggtagctacttttcacagacaggttgtcctgatgtctttctgtgagtccagctgagtccagggttttcctgggcttcagaagggaggaaatgcatgctgattggtccatgggcagccatgggtgggcccagaaaaagcaccataagttctcactcctggccgtggactccacctggaattccacctgaaggtgggtctttaccccttcccacagaggagcctgtctgcctcctacttccttaatcatgttgtccatagtgcccagtctgttcaagtggagggggcctgcaggcccacactgagccaccctcagcagccccaactcagaaggaggtggggctcccagctgttccaggctcccacaggctcagcagagcacgcagccccagccatgcttctcctgctgcaactggcatccccgcacccagctctggacattagatacacgtaatatctttgttgcagtcctcattttcccagaccatgcctgagagtgttccactttgtatggaggaatatgtgggtattttcataaatgaggacccctctactagaaagtaacaaagtattttcctgaacaaaattgtacttatctatgaagtagaagaaattgtatcagttttggttttaaattctaaatgatcttgccttttccacgctgctgaaaagatttccccagtttccagtcttgcattgtgcatttgtctcttcccctttaattcagcaattctactgatggctttccaagtaacagccccttctgtatcattgtggcctttggaacattttggttcctggactgcctttcttccaggacctcaatgaatctctcaagctacagatttcaatagcaaaattaccatttaatagctgagaaaactgaagcccaccaatattaaataagttaccgaaagccaaatggtgcctgagctaggactacaaacctgatatggtagattttttctatattttaagcctgaacaatgcaaattgcgatttcatataaatctcacagttctcagagttctgtggcctgtttccaggcacttgtgcttgttggttctttttctttttttgcataaacttgctttgtttgcttctcttacctctactcctggttattttgtccaaattggtccaagtttgattcaggtaagcctggactcttatctccatgaagaatgaaggtgtatgccccaaaacaccgaataaagatggactaaatggatgaaaagagctactcttggtaaggaagtttgccaggatattacactagaagttcaattcagcagccattaaaaggtctgtttccctggggagttctctactgaaaagacattagagcctttctcccttgcttctttttgtatagcagcttttacatggtagctgctgaatgcacagaataatgtggctgatccattgaagacccagcttgctcaggttagaaagacagagctgtgttactaggcaaagtgtaagaacaatttatgataaataagtgtgatgaagggaaggttcttggcttcactcaagcctgcggtggaagaaagcagctttacttaagcagcagtgtttatgcttggtgattgccccttgcagagcagggctagcccataggcagtgcgtggagagtagccacgcatgggctgttggctagctgcatttatacccactattaattgtatgcagattaggtggtgggttatttagaaatcaatagaaaatggggtggtaacttctgggtgttgccatgtgaaggggtggtaacgcagcgttgccatggcatttgtaaccgtcatggcactggtgggagtgtcttatgctgatgggcagtgaggacaactagaggttgttttctgtgccacttgctggttctggccagtgtcctctttggtttgggaaacaagccctgcaagtctcctacttcaggaggctgtggaagagggcaactaacttctcaggagggatcagaccattgcaggacaggaggcctgtggaaggaaaagaagacaggaggagatggttttcttattttagaaaaaagaaaggttttcttcttttagacacctgggccatgactcttcacttgttctttctcaagaacagtctggacactgagaccagaacctgggacttttaaattttaagcatatttttatgtatatgttgtcctgtctagcggagggtgggggagtctttcttttttttctttgcataaatctctaaattaaaattctccagctattgttacacataaattccagggctgcacagatcgatctgagtgttcccattaagtttctgattctaatgaagggaggactttacagcatcttccactgtctcccaacgcatcacacctcttcctgcttttccctgacccacctgccatttagaaaaacatattctctcagccctgctttgtgctctaaatgttaaatacatttgattgtccatacaattttatttgaaattcaatatctgctttggacagaaagtgttattgacctgctgtatccatacactatttactttgaaaataaaaaagtggatttactttgaaaagaaaaaaattttaatgatttttttaaaatcctaagtaatcatgatgatgcccttaagaaagtttttaaaaacataattagacgtattttgtaattgggatcattcagactgccaagtgttcaagcttttccttatttgaaggcacattaattttttaaaataatcattaacgaagaatttacttctcttaaaactaggttagctattgttctctctctgtctcaactaatgagtttgatattcacaagaactaattgtgagattttgtaaagccaatgctatgtcaactatgctggaataagactttatgagaaaaacataaacatacataagctgtcaaataaatcattctgaatgatgtggtagaaagcttggtgctaggagacctgataggaattttaatttacccatttacttattcatcaaaagtatataaagcactgatcctaagagaagcagcaaagccagctgcaatttcccagcagtgtaaccttgcgccaatgactatatcctctctgatcctttgtcaccctaaatgtaacatgaaggaaaaaatatccattacagcataatataataattactataaaatataatatttacccaagattcttatgagtatctgatgaggtgacatactaaaatagatgagacaacagagttggaagcattttagaagacctaaagtcattagtggtgtttgtgctaataatgaaacatctattactctgggtcctttgctgagttccataagaaggagaaggttatgtaagaccttattgtgggctttacatgctttggcatccagtacaatggaaagagttagaaaatagaggagcattgaaagagaatccccaaggctgggtttagtactgcaatttgcaaatgagggcattagtgaaaagcatcctccatggatgtgaagcagaacttgcagtaggcagcagtgctctgggagggcattttagagggggatacacagcactgaaccttgaaagatggagaaactcagtgaacacagatgggtccggaaatgcacacaggacatcagtctacttacaggatggtttccgagagcaacaaagtgagtgaaaagactaacaactaaaaatgaggagaggtttggatagcagagaagagtggagtgattcttccttaaaggggaattgacacttaacatcagatgaatgacttagaacctagatctatcagttatactttgcactgaaaagctacaaacttttaacacttagctgtcccatctgtgaatctctgtggctcattattgctgtgaggattaggtgaaataaatacatcacagtgtctggcatatattaaattcctaataaactttcagttttatttttctactttccttttccttctctttatattggcagtggggtttctggcccttaatttagagtggaaacaccttatggttttctcttatcacattttatgacttagatatctcttatgtttatatcatctgctccctacatagtctgggcccggaaatgattatactcagagcatctctagcaagacagctagataagcagataaatgcagccctcaactttttattaatcaattgaaactacttttccatttaaatcaaagccctttaaaacttccgaattatattattaatgtccaggagaagatatgccatcagttaagtatcctctgctgcctattggctgctgtctacttattgtaaaaaaactagctatttctaagtgttgatgatttcagatttgagttcatcttgttaagtggttcagaacatcaactcttagcatacattccctactgctaaataaaaggtgacccttcttttaatcgtttttgtggtttctcattagagaataggtaaataatgaaataactagagtcttcccttgctttcattcagttttgtgttgttctttccttccagttctttgcaactacacgatcaaaaacattttttttggtgcacattaaaaagactagagaaatgctttaatactttcgaagactgaatatcttaaaaatggctccaattctactgtcttattcaagcaaggtatttacttcttatttcttttctatccatttcatgaccttgttttatttcaagcactatcacagagtcagatggaccttaactcacctgagcaaaggcaacctagagccacacagctgagctgccctctttgtggcatcacgttgtccctctgccccacagagtcacctccccacttcccttttccagccctactgcccttttgtaagtgtaagacatcatttcctctcaactgcataacagaaatagcctctgaaagggcctttttacagctgatttcttctgtctccaattcatcgtccatactgcatccaaagtcttcttgccactgccttcaaaatttaaagctgattcctaaattatgaatctttgtcactgggaaggcaaaggacagttgcatagtctggttgagtgaagttttgcccacacttaactgaaaaaaaaaaaaaaaagattcctgtgccccttctgagacttgctgaatcagatttgaggaaaaatcctggaaatctataaacttagtaagcataataagtgacatttataagtggcctctttagaaagccagccctgcagagtacacagaatgaaaatctaaaagtctgagaatcccaggttagaattgcaatactgcatttaacatctgcagagagcttccaggtaagtcacttaacttccctgactacattttcccattgaaaaacagaggtattaccaacttacactcatcactactctgaggctcaaatatgacaaaatacataaaaaggctgacactcaatgtataattgaaccttccacttccctttttgatctaaacaattactcttctgaatatggtggaaaggttgaatggtacatttctccctccttccctgctaccctgccccccacatgccagctgggcttgcaaaaggcagaactggattccaaaattatagcagcagccagtatggtcttcggtttccctgcagacacatgagtcaatggagacccacaggactgaaacatagagggtttatgtttccctgaaaagcaacagaactggcgaaaacagctctgtttctcagagatgagtgcaaactggacttataatgaaaagtcaccaggatgtgcccagagaagtttccagcaggaacacctgcccaaagaataatgtgggaccgtgcttcagcaccacattccagaactctgagtccaaacagacccagactaccgggaagctcctgcaagcagagcaggacaggtgttgatgcacatctgagacggggagttcctgggctcaggagaagggaaagcctcctgagcagcagcccagcagggagagaggcactagccagtgggtctacgtccaagaactgccacaaaggtcttaatgcatggtgccaacactatactctggctattgccaagcttgactcctcagaggatctctggggtcataacttgctctacacaattgttctgaaggtgattgcaggtgtgatttctagaggtggcctgaggcaggctcaagtggaccccagattattgagacctagaaatgggaggcacacactctggttaggtgggcagatgtttaatgtggaatccagtatggggcatggtttgtaggcagcattttgcagaaaatatgtccaatatgccctgcctggttttgtgaggccagttccagtcccctcactaacctgtcctggagtctggatggcttgattaagattctggaccacagagaacccagacaactgaagctatctttccctgcaagtggccactaaggggtctttcctttcttctaaagctcaaagcttcaaaatagtggtgtgaggttgaataagccatttaatctcctcagtactctcaagtatatagcggggctaacaggctgactgcggctaactaggataacaattcgaatgcctagtatacctgttgtagagtgctagcctcattgttattccccttttacttttccttcttctgccagagagatcatctgggtattcatttgtgtgcttaccgtctgacacttgcatttacatcattatctgccactccaggttatttttctcctctgagagccaaggatgacaaaatcttccttagggtaatcctacctgtggagagagggcaagtacgaatggtgtttctctagtacctgcaggactagtaggtgtggggatgtaagagcactgaaatgaaaaagtgaacatccttagagactggctgctttgggagtaaggcagatgttctaacgatttagagaaactctcagaacaaagcagggataggctttgggaaccaggatatgggattctgaagtgggaacaaatccaaagaagcatcattcactcatttcacacatttatcaagacactagaatgtgacagtgaacctatcagacttgcttctaggcttatagagctgagagagtggtgagggagactgttatgtggtcagaatggtgcaccatcaacgttcccccactcccagttaggactaaggcactgattctcccagctactgggaggcttggctgctgacaggtgagagctcacagctgtatatctcttccagaattgcctttgcggaggagagctgacacaggtgtcagctagcatcttgcagctggtagacacagggacccagccctcttccctcatctcagacaaattttatcttcagagtaaccccagggcttgactgaggtctccgttgcagctgcattacagttcacttgttccctagacccagttcttttttttaattgacgtataattcacgcattataaaatacatccatttaaagtataaaatttggtagttttttagcatatacataaaaagttcttcaaacatcacccctatctaattccagagttctcatcacctgcctgccaataaaaccaaaaacaacaacaaaacaacagcaacaaaaatccatactcattagtagttgcccctcattcatacctacccccattccctggaaaccactaatctactttctgtctctatggctttgcctgtttcagacattttattttacatcttattatacttacgtagccttttgtatctggcttctttcattcagcataaacttttcaaggttcttttacattgtagcttgcaacaccatttcattatttttattgtcaaataatactgaattgcatggatataccacagtttatctttttatcaactgatgggcatctttcctctttttgattattataaacaatgcttctttgaatattcatgtgcaagtttttgagtagacatgtgtttttaattctcttctctatatacccagaggtgaaattgctgagttatatggtagctttatgttaaacatattgaagaacagtcaaattgttttctgaaggggttaccccatttttcattctcaccagcaatgtatgcggggcttcgacttttctgtgtccttcccattacttgctattacctgtctttttgattctagttatagtagtgtgtgtgccgtggtattccattgtgatttttattttcctctacctaacagctagtaatattgagcatcttcttatgtgcttacaggctgtttgtatattttttttgagaactgtatatacaaatattttgcccattttttaattatagacactttttttttttttttgaggcagggtctcactctgtcacccaggctttagtgtagtggcatgataatggttcacttcagccttgacctcctgggctcaagtcatccccccatttcagcctcccaagtagttgggaatacaggtgtgcacgaccatgcccagctaacttatttgcttagagacagggtctcactgtgttgcccaggctggccttgagctcctggactcaagacatcctccttcctcagcctcccaaagtgttgagattacagaggtgagccaccacacccagtcagttggtcattttttattattgagttgtcagagttctttatgtattatgcatccaagtcctttatcagttacatgatttacaaatattttctcccattctctatgctgtcttcactttcttcatggtgttctttaaagtacaaacatttgtcattttgatgaagtcaggtctatcttttttattgttttgttgcttgtgcttttggtgttatatctaaaaaatcattgcctaacccaaggtcatgaagatttgcacctatggatttatttctaagagttttataatttcagctcttatatttatatctttgatacatcttgagttaattttttcctttgtgcagttctgatcatcccaatactttacaggtattgctcccaagtacactacccaataaatctcttacactaaaatatttatctaaagtttatttttctagaatcagacagattattcatagaagtacaggtacaatatggtaattgaggaagtggtggaaactctaagcacagctgtccaggcagggttctgacggctggcatccttccaaagggcaggcagtcctgtagaacatccttactggtttggacttcttttttcccagctttgctctaaaatctatactattttatgacagtgtttcagtcgtagagttcaaagcacaggcaaattgacattcaaaacttattatcggatgaagttacatatctgtttatatatttcaacaagggaaagctaatcaatattctgtagcaattgttaccatgtaacatacgattaaatattataaaagtgagcctattacatgagaaataaatataattatgtttggtccaggctgttaaaaatgcatactttctatatattatatgttaatgtgcaagatggagtggatttctgcttatttatttaaaaagaaattaaagtagtacatttagcgtacattgtgtgtctagatgtttacagattgattgtctttttggagatattttagcttattgtattgtaccatggagtaaactttatgctcagaagttctaaaggaaaaagtgtaagagattactggaattgaagatttttgcatttatatgtttaaattaaattttgattagctgttttaagctttgtcaagcattaggagctcataatcatagagagtttgatatgaaggataccataatcagctactctgtgctttcattttacataaaaagaatcttcaactcaaagaagaagactggggtaattggccccaggttgtggatgaatcagctatgactccatttggtatccatatctgaccattcctagccccagggctcagttcttgcaacaagctgcctggatgttttccaatgtggctcaatgctgttaatttaaaagatgcgtaagtttctgttaagacatttgtgagttggggcagaggaataaaaggcatgtagcttttttcatcaagtgtgacaacacctgggtgttaggaaacacacataatcaacttagatgctcatcagtggtgggctggatgaagaaaatgtggtacatatataccagggaatactacacagccattagaaagtgaaatcatatccttttcagcaacatggatgcagctggtggcccttatcttaagcaaaataatgcaggaagagaaagacaaatactgcatgttctcacttacaagtgggagctaagtactgagtgcacatggacgcaaagatgggaacaacagacactgggcctacttgaggtgggagggtaggaggagggtgaaaatcaaaaactacctatcgggtattatgcttaccacctgggagaggacataccttgtacaccaaatcccagagacatgcaatttacccatgttacaaacctgcacatgtaccccctgcacctaaaataaatgttgaaaaaaaaagccactaaaatagtatttcacatcacttttcattgctaacagtttgttccgtcaaaatactttctaaatggatccattattgtttgtcagtatataataacgtgtgtaaattcccatagatatgcctgagttttacacttttcatttcatatcagagaaaaaagcttgaaaaataactcttgatattgagaattttaacagtgagattttattatactcaaatgaacaagttctcatcttcatagcccatatgtgagactttttgttaccaaattgtaaaaaaaaaaaaaaaaaaaaaaaaaaaatcatgtaacgtagattaaaaatctaatttcaaagactggaacaacaacaaaaagaaaacaaaggcaacagcacacagatgactgtgacttgcctttggcccatctgcagatattaaagccctggggccagaagcaagtctttctcttgctgagagaggacctgcctgcagcaactcctaggaaggctgatgagcaggtagtacttcctggagcagaatgggccacccttctcctttggctccattcagaggaatagccccagggagaggtcctggaaagtattataataattgcagaaatgaaagaaaaaacccttgttctgaagcaaagggtggacttttaattttaatagtagctaattatccgtgtctgtaataattctgctgtttttgatgtttttaaagattaaaaacaaaatctcagaatagctttcataaatcaatttgaccttgccgtgaaaccaaaacaacggttaattcactcgaagcagagatataataggttcaaatagcaacatatctcccagagtcaatttcaacaagacaaaaacagaataaagtggttcatatttttatgttaaaagtaattttataggattccttttgttgcgctgaatttaaataaatcattataaacctaatatatgcctaatactgtcaccatgctgtggcaaccactgttaatatttccatgtgttttctttgaactttttttaattctttgcatgggtttttaaaagagtgttttagattctgtcataccagatggagaaacctctgcccctactctgaagggatatccccaaatgacattccttggaattctgcatcccttgaaaaaggacgactggctgtcttctgcatgagctgttccgagacccactaaaattggccagggtgactggtacagtcataggagggttcagccaagccatagcattgtccagagcaaggatggcgtaaagaaggctttaacaaaatatatttgattataaaaaaaacttctgctaggaatgtacaaagttcattgtccatccggacacccaggaataagtgagaggtacatactaattagtattttctaacattgcttacttctgccccctgcctagtcacaggctgagagaagaatgcagcaagaagcatcttaactggaggcccattctaagtccattttgaggatgaggaaacaggccagggaggttaaacgacttgtcccaggtactgtggctggaagagaggctataccttacctactctcctgggtgcccttttacctctgtctttagaggaagtgcatagatttttctcatttggctcttgagacctgggataaacatagtgctaccctaagtcttgcagttacaagaatggaaatattctgatttaagttatagacatttgtttgaattttaccattacacattttttaaatcacagataagatttttcacttgaatgaaaagtgaatattataaaccatgaaagcttatatgaggctacaaaataagttgggagtggctatctgagaagaaaagaaagatgcaaaatctaactggcaaaggaataaaatcaaatcagacaccaacataaccagcttcttccgccttcccttagatgatagtcctgaagctgctatgctgaacatctgatgggaagtaaaaggcattaacactctgtaaaacatggcaaggaatatattctataacagttcccctgcagatgaaaatttgccctgaggtatagttcctcagagaaaatgagtttttttctctttagtaaattttttaaagcctttttgtttgtttgtttgacagcctgtgctgcagttctaggttctaagcatatacaccttatattcctgttaatggaatttcagactcaatgtttgcctcaccttttgtgtatagttcctcaatggcctatattggatacaaagtcttacacagttttcacccaactctagtgattaaaaaaaagaaagatctgattggagcacagtgcagaaggagagagtggcatcattttggagctctgcatttctggatacctaccttgcctttgtcacttgtcaggtctatgattttaaagaataattgaactcctttgaatcaccactttatctgcagatgaggtctggaatagtcagagatggttttctgtaacaagtgagtttcatttgggatttgtataatcagaaagatgataaggggcaaaccataatcaaagccccagagatgcttagcaatgagagcaaccatgctgaggcatagtaaactatgacactgatcagataatcaaggtgaggtgcaaagtcaggtagaagtgctcagtgctgaggtagtaagaactagggaaccaatagaggcttttgactcatggtctgagaagatgagaaacagccactggaagacagatccagtagatggacaagagggattgatttgaatattttggagcctggggagtaacctagagatgaatatcgccaggtcattcaggtttttgtttggttgtgtgattacaactaacagagactataatttaaaagcttggtggaacagattactaacaaactaataaattatcccaatctcaaggctaatcaaacctatattttggttgatttttctacaaggttgtgtcaaggttataggtaaggggtgatcactgagtccccgtcaatgagatacttgcccctgggtggacaagtgagtactagttgccataaataaaatcaagcacctctgctaccaacatttttgcatttcacatcagagagctgagttccgtatcttctcatggtgatctttgatccaagttaaaggccgacattaatgttaacagtattttctctactgtatattgtgactcatttttgagttgcagatgagactgaaactagaacttctcttctttgcagagtcataagtcatgttaaaatattaaaagctcagaatagtcctaatcggtttaactttgtataaacactcagatatcttgcatttctttgtttacaagtccatttctcttgtaatttccctgaatatccaatggacctagaactgtccaaaacaatgtagacaatcgctaggtctaagatatttgactttaaccaaaattgttaacaaaatatcttttccttctaggacagtggctcaatatttaatttcattggaaaccacaggctaagtctgagtatatttatgagttatattttcagctacctagatgatttacaacatgataatttagaaggagtagaaaacttggagttaaaaattctgagttaaaacctatcttgatcacaacctaagactatacatgttcaatggatagtctttttatttattcagtgtagtttcctcatttataaatataataaaacccacctgtaggtaatcatgaggctcaaaaacgactgcacatgagaatcttttgtaatagctaagcctcattagaagctgtattctggtttgaatgtgcttgtagcctatatgtttgtgttgctgcaactcctaccttgctaaaaagagataaaggaacccatctagggaaactgttatgctaaggttgagttcctaaagccatggtgtacttcaaattagggaacaggaggagttgaacaagaccatcaaggaaaaaatttattatatacagatttctggcacgatttacaaataggcaggtccctgggctgatacagaacatgcaatgctgatatgttctggatatctgggacagtgtttgcaaaacaaatagaaattgaatgcctttatgttagtcataggactcactgctaatttattaatttacgtcttgctcaagacctatttatgtccctcctttgttcccaggaacattagaggttgctaacgttgctctaagacttgagcttaattaaggtgacctttgagatgaactggtccttatcagggccagtgaggccatgaagagactagatccaagcagtatgttttaactggcctacacaggtctccctcagcagccctgagccagggaactcaacaatattttagggaaacaagaagtctacttaactgataggagtcagatttgtacctgggactgctgatccaaagcctataaggaaaaacatagccaaaaagaatctgccttaaactgatgtgaactgactatccagatccatataattagaaataatattagaagacatcttaatgtatatagtatcttatggaacacagttttttttgtgtgtgtttttaagcagactttatgtaccaaattaagaaattattattttaatgatgaagtcttggctgggcgcagtggctcacgcctgtaatcccaacagtttgggaggccgaggtaggtggatccctgaggtcaggagttcaaaaccagcctgaccaacagggtgaaacctgtctctactaaaaatacaaaaattagcttggtgtggtggcaggcacctgtaatcccagttactcgggaggctgaggcaggaggattgcttgaatctgagagacggaggttgcagtgagctgagatcgtgccattgcactccagcctgggtgacaaaaaaataaaaaataaaaaagttatttgctctagggcatgcagatggaaaggggttgcaacaggtactggagtcagcattgctgtccaaagccttatatgcacccacccccccaactacctacctccctgggataagattactaatgacattattttccttaggagcagacctctttcacacagcagtatacaagctgttttgctttctacctgatgttgagaaaggcctgactcttagatgttgcctgatagctactattttctcactttgcatcacattagtgggagccgttgctggagagtttcataaggaacattctgttaagaatgtgtaaatttagattactaccactgggaatttaaaacaatgaagagaacaaattctgctaaaatatggctctgaccatctttaagacagatgctgtgaccgtcctttagctcatggctaatctgaaggagctagtctgtggagacaggggcttccttagcaatgcctcagataaaaacttgggcccagttctcaaactcataactgaaatatttcagattaaatccctcctccttgttgctgatcagtccacgtactcttttccttaaaccccattgaaaattcactgtcctctaggtgccatcattctgtagtggtgggagtacagattggcataacctttcagaaagcagacaggcaatacaaagcaataataatatatggcaatattaagggagtctatattcatgattgagtaaccaccatgctgtgaaatgaaatgtggtcaaagatttatatgcaagagtttaataacattgcattgttatttattatagcaactctttcaaaagtgtgcgatgagagggtattatttatataaataactttgcaatcatatgatggaatattattctgccaagataaaattatgtatttgagaaatatacttactgatgtgaaaaagtgcttaagacataataggttaagaaaagacagacagaagaggtatgcatgtaattgtgtgtgtgtgtgtgtgtgtgtgtgtgtgtttctgaacatcacaggcttcattagccgatggatacaaagagatcacatcaaagtccacagtacaatggtcttacaactttacaatcttctcacaaagcgagtacaaacctgtgctcagtaccaaacccaggtagactgttttctccctttcctggccttcttatcaaagctgtttccatggaccttgctgtggacatctttcattagaacgctctggtagctgtatcacttagaactcagggatgccattctattagaaaggaggtgctcttaactctcaaatttttcttggtcttaaatattgcattgagataagggaataaggaagaaaataaaaatgcatctaatgcctaaaaatatatggactgttgctaggcatttcaccccattcatgtcatctgttaattgtcagatgttgtcactctctctgtttttaatacagaacttcaacagatcttaagagcattctactcagtcattttagatttgaggtgctattctgctctctaggaagatagggagtctcaatcctgacccagactcagttcccgagtgcggtactgtttcccactgacagatgccactgactttgcctgcctgagtctctaaatattgcagctatctagctgtattccatctgcccacctgtttggactttcatgagtccaactgctttcctggcctcccaccagttgcctaatagcattctacttgatggaatccatgttccctgcccttctgcataccagcatctgcagccgaccttccaataccgatcccagcatagtaggccaatctaggtccaagaccaaggtctcctagcctaaggatttaccactgtggttaaccctgccctgcctgggcacaacaccttcacaattcttgaagcactacgtgccatgacacacacatttgaagtttttttcagaatcttccatgtttaaacttttggctgttccagtttccccaaattaaattatctggaaagagtgagcagctgaaatttgagtgcatttttgaagtttaagaactgaaaaaagaaaggaatatggccaatttaatattcctgtctcttaatccacttcacatgggagaatggaggtgaagtgaggttgtggaaaataataaagccaattactttgcctgttcctttgtttgatatactgcactcttttttattttttcttttccaaaaagcagagatcagccagtacaaaatggtggttttcccatcctgggtatatcaggcccagatcatcaattattattgcagcattctatatttgctctcatagatagtgaaagctttgctatattaatgaggaatttttgatttcaggctgtgccttctttgctcgtctcagctcttggctcttcctaaaaactgtattagccaggaaactgagcccactgattttttaatctatccttaaccctgccctggaacacttagcaatttaggcatgtggcaggaagaactgaaatttctaagccgttcactcctgagactaataccgagtcctcttcatttatccttgacctttttagttttcagccttgctccctaggggtacttccatgaagacagttgcttcctgccccatattaacaaccctcagtgaatgtcacagtagagtaacagcgaattgcaaataaagacggccaacaatcatttggcatttgaggaaagccatagcataaaacagggtcactgaacttaataaaaaggaaaagttatgagagtaaaggaaatatcatgaatggcctaatctttctgtcctggatggtctttattccttaataccatcaaccactcaaggtgctgctgtgtccctctcagaggtccactctcactcctcctacctgaaaagaaactcactagttgctaattaccaatatccacttagggtgagttggttgggacatgctaattcctccttgctgaccctactgtgatattcctgtgattggcctggtcatttttccctgggcctcacttgcagcaagctgcttaggtaggaaacacttagagccactcctcacattatgaggtaagattctcctctggttgtctgaagctgtaatctccattttcaatctggtcctccttcatttccagatgtgttaaggaattttttaaaaaatttctatctgttatgtcattaagaaggatttgtagcaggaaaacgaggctggcaccttttctcaagaagctatcttgacctgaaacttacattctttcatcatcatgccattttcatctggtttcctgagagctgcctttggcagtcacagttggaaatgacattttatacaggctcttatatcagagcaaagtatggtcctgataaaaggttgtgtgaaaatgttcagcaaacacctctcaatcccctgtgctttgatgtcctgcatgcttttataatggccacactccagggcagctggagacaggaaatttcatataactgggttgtgtctgaacagaatcagcacactccacgatgagattcaccatattcacatttggtatattccctttccatttctttcaaacttccgtattaaaaatgcaagatttacattagtatagaatactaaccatcaactattatcaaaggaaacagaatggggagatgaacaaagagaaagagatgacccagaatcagaaaccctgggttagtcttggctctcagtgattaagcaatttgtccagcatcacagatctacaatgatcttacagtctcaatccctcattttcttcttttacaaagccaatggttggcagaggctgactagatttcatgaccctccatcttgttcctgttctgagcttttatgaagttgatcttattgtcatcagcctatcatcagctttgcaggacagccagatgaaaggagtgcaggacagacactccttagaatccctttgtaagtttttcaaagatttgctttgttcagatctctgaaccattattggggactgtagaataggtactgaagaagaaagaatgcctcgcttaagttcaattcagtcctgtacactcagagtgatctctctgatatgagaaagggagttgttgacctttggattaagtgattccaagagaaaggactgtttagagcgagggttagcaaactaccaccttcaggccaaatctggtccaccaactctgttgtatggctgacaagctaagaatggtcttcacatttttaaaaaatcagaataataatattttgtgacatgtgaaaatcatgtgaaattcaaatgtcagtgtctgtaaataaaaagttgtattagaatatggccatactcagttatttacctattgtctatggtggctttagagctacaacagagttgaacagttgcaatagcaaccttctggcccccatagcctaaaatatttactatctggccttttataaaaaaaaattgatgatcattggtttacagagatgtattgagagttaacaatctgcaggacataaggaaagaatagcaactgatagtttacagatgtcttcatgggaaaggtattctagaagttcaaggacaagatattattgagtataaacatacacagagcaagaagcagcagtggatgtatacgcttacaaatgcacaggcagatgccccccatgtataaattttcaactcggctgtcctttgtgataacacttggcagaaaaaacttcaataactgaacacaatacctttagcgttgaccattgttattttcttttttttaattatttctatagcattgacattttattaggtattgtaagtgatctagaaatgatttttaaatatatgagaggatatgtgtaggttatatgcaaatactgtgccattttctttttttattttattttatttttttatttttattttttctaattttttttattatactttaagttttagggtacatgtacacaacgtgcaggttagttacatatgtatacatgtgccacatgtgccatgttggtgtgcagcacccattaactcatcatttaacattaggtatatctcctaatgttatccctccccactccccgcaccctacaacaggtcccagtgtatgatgttccccttcctgtgtccatgtgttctcattgttcaattcccacctatgagtgagaacatgtggtgtttggttttttgtccttgcgatagtttgctgagaatgatggtttccagcttcatccatggccctatgaaggacatgaactcatcattttttatggctgcatagtattccatggtgtacatgtgccacattttcttaatccagtctatcgttgttggacatttggcttggttccaagtctttgctattgtgaatagtgcctcaataaacatacgtgtgcatgtgtctttatagcagcatgatttataatcctttgggtttatacccagtaatggtactgctgagtcaaatggtatttctagttctagatccctgaggaatcaccacactgaattccacaatggttgaactagtttacagtcccattgttattttcttagcctcttacccattggcttatttgtgctaagttttgaggattcctttttaaactgatgtttaactgtattatattcagtgagtacaaaagaagtgagagtttcaaaactactgataagaaatggcatataattattaaagaaggaaaaataaagaagacgaaaaaataaagggaagttaacgatcactacctgataaatatttggacgcgaatcatgattttgaaggacaaagaatgaaatgtgtgcaaaagcagtgtggatacaacccagactaaccagctggtgcagagggacactggtaaactagacaatctttgcagtgtgtcttgtgtttacaacaatgcaaatgcccgttagattaatgctgttgagaaaaagaacaggagttttggaatgaaaggctcatcatggttaaaatgctgctgaaaaaatgcttgtcatgaggtgcaggagctttcaaaggaaaagggtcactattgtgtcaaagaaaacacagctcctagggagtcataggataaggcacttataggatcatcaacaaacagtagtacctgcatgtacgcattctcagagtatgtggaaattggcttatttcaaaaaacaaaaccactgataggctcaatagaatgttatcatccaggaggagcaggagtgatgcttaatttgaaagagttggagtgtctgcacacaccatcatttgctgccaatttatttagcactaagcttaaaatcctctttggaggagtaactttggtcttttaaagaaaagaaattaaagcaagtttttagaaacagacattagtaaatgcacgtgttcttgctgatacatacagagggaagcagtcagagagaaggatgaacagattataagtcaactctgaagggtgtcagtagaggttcagtaatgggcagagtctagaaaatattatcaatatatacagaaatgtctgtgtatgttaaattaagggaacctctgcagagacgaaaagaagagattttgtaccattcatgatgacatttgaaaataacatttttaaacctctcattttatggtgacaatagatgcccatctctttcacatagagaagtttaatttgaaataaaagtaaggaatattctttttattttatgatgacagtctcatgctcaacaaagatttagagaagttagtgcaacatggaaaattgagttgtggtgtaaaatgtataacttcttgctacatagctgattgtgaatttgttctttatatgaatttttttaaagaaataattgaagtttataaataaaatatttatgaatatgacttcattaagaccaggtgtcaggtgtatcttagttctgttttaattatatacatatacacacacacatatatatttcttttatgttctacatactctgctttatagctgaactcatctgtatttgtccattttcatgctgctgataaagacatacccgagactgggtaatttattaagaagaaggtttaatggactcacagttccacatggctggggaggcctcacaatcatggcggaaggcttgtcttacatggtggcagatgagaggatgaaaaccaagcgaaaagggtttcctcttataaaaccatcagatcagatcttgtgagacttattcactaccacgagaacagtatggggaaaaccgctcccattatatcccactggatctctcccacaacacgtgagatttatgcgagctacaattcaagatgagatttgggtggggacacagccaaactatataatcatcatccaaactgaaagttgtagtaggatttgtattaacaaatatttgaaatctgagttataatttgtcaaatctatgatatgcatctaaaaaattaccattttcttaaaatggttataggatactctaatattcagctagtaacaagtgctttttgggtcaggaaaacattttttaacaaactgatacttatcaaatcttagaagtttgatgtcattatgttgaacttctactacaattaagtgagaagataaatgcagagtaaaggtttctaatagcattttttatttataatctcaatatatgttcatttcataaaattttaaaaattaagagaagtgtgaaaagactctacaataccatcaccaagggataagtaataagtatttattttcttttatattttttaatctactatgtatatgtataaaaatatagatattattgagtaatattattgctttcattttccaaaactctcttctaaatagtatttctatttttagttataattttaaaatttaagtggcttcattgtttttataaaatatgtgattattttaaaatgtaacgatgtatgtacacaaaataaaaatacatgaatatatatttatatggaaacgtatacttataaatgataaaagaccaaaataaatgttactccaaagtctacaactcagtactaattatattaaaaattaagtgaatatctttctaaacaatcactctgctgatttatatctatctataggtattaaatatcccaagaatgtacagatatctccaattccaattcagtgttacagtattcattctagccttccctctttccttatgctaccttccttcttcaacagttaaaagtatggctttcattatctataacatatatacttatttgttcagtcctaatatgcacataaagaatcccacaattttcaacctatatctgtataaaaaacaagtttacttacttaagtgtagcatttgtgcacaaaaagtgtttgataaatttttctgggccaaaaatagcaactgtaggaaactgacaaaggtaggacaaagacatggttttccctcagatatccgcgtagttaactccttcactcccatcaggtagtgctcatgttcctgtcttctccgcagcctacgttggtggactattaatagcataatctcaccctccaccccacctagaccatcttgatcctttttctcctactttgtttcccatagcacttatcacattatagcgtgcatgttcaacatacacatttttttttaaagtgtacttttacatctctgaaaggtggattctgataatcaatgacatcataattcaattggaggcttgcaatgtactgtattttagatttaataagtcatggcacataatttgcttatttatcttacattctattttgcccaattaggatggataagttgacaaagtcaaagttattaaagagaatatcgtaactgctataagaaagcaaacctcaaatctcagtgcattaaaagaacaagggtttatttttctcttgtgtcatcgcaggcactctgttccacatagggaacagagcaccctctgttggattctctacctccagtcagcttaaaatggagagggttgaaaattacttaaaagtactgtattcaagagaaagcctggaattagagtttatcacttctgcctcgtgtctttttttttctgtattaatcagagtattctaattgctgtgatgttgtgggttgaatcctgtatcccctaaaaagacatactaaagtcttaagccctagtacctgtatcgtaatgtaatattacttgaaaatagtctgcagatgtaaccaagttaaggtgggatcatacaggattaattgggccctgaatccaatgcctgatatcttcataaagagagagaaacttgaagatggaggacacacagagaagaagttcatgggatgactgaggcatggactggagttatgctgccaaaagcccaggaacacaaaggattgctgccaatagccagaaactggaagaggcaaggaaggattctttcctacagccattggaaggagtatggccctgctaaccccttgatttaggacttctagcctctagaattgtcaaagaatgaaattctgttgttttaagccatttggtttatagtaattcattacacctgccctgggaaattaataccccactccttgtaccaaaatgcgtatcagcgttctctagagaaacagaagaaatatgaatagtgatgattaattagtatactgatctacattatactataatcacattatataatcatatcctatatgaagagatttattttagggagttggcttacatgattatggggtctatttagtctgagatctgtagggcaggccagctgactggaaattcaggcaggagttggtactgtatccttgaggcagaatttctttttccagaaaaacttcagttttgctcttcaggcctttagctaattgtaggatgaggccctcacaaactattgagggtgaacttctcttacttaaagtcaaccaattgtagatgttaaccatatctccaaaattctgtcacagcaacatctgaattagtgtttggttaaataactgggtactatagcctagtgaagttgacatataaaggtaagcatcacatatgaaaaagtaaatcaacatttttgctacttgacccaacaaaagtttatttctttctctcatcatggccaaatattgtgtctattggtgtggatggagaggaattctggcctccatatagccacagaaaaaattgggaatgaatttagaaatacagaacccatctcgcagctcatccctctagggctgcaggataattttaaaaatcacttgaggtcaggagtttgagaccagcctggtcaacatggcgaaaccccatttctactaaaaatacaaaaattttccaggcgtggtggtgtgcgcctgtaatcccagctacttgggaggttgaggcaggaggaacacttgaacctgggacacagatgttgcagtgggctgagatcacaccactgcactccagcctgggcaacaaagcgagactgagtctaacaattaaaaaataaagggcttcaagtgttatatgcttgttttgacttgtatacatgccagtagtgatgcctcatacagaacttggcttaccgaatgatcaatacacattaactctcttttttcctttcatatctgggaataaagttgatgaagctgcatcatctagcccaggaactagaatatatcttttttcttacattggtcagaactcagaaacttggctctgcttacctgcaagggcatctggtaaatatagtcttcctgtgtgcctgagagggaaatgaaatgttttgatagatacatcataaccctgtctttgctgtgtagggcttttctgctttgttcaatgttataatccaagcatctagaatagctcatacagtagttcctgctaattcatgagggacatgttccaaggccacagagaacgcctgaaaccatggatattactgaatcccatgtttttattttttaattattttcttagatacagcatctcaatctgtcacccataccagagttgtagtggtggtattatatgtcgctgctgcctcaaacttctggcctcaagtgatcctcctgcctcagcctgtggcgtagctgggactacaggcgcaagccaccacacctggctaaaactatattttcttttatacatgcacacctatgataaagttaatttataaattaggcacagtaagagattaacaacaataacttatgataagatagaataattataacaatatactgtactagacactatgtgaagatgatctatctctctcaaaatactataatatttttggaccataattgactatagataactgaagtcacagaaggtatatttgtggagaagatgggggactactgtattagactctgaaacatgcttattgcattagtaattgctatgatttgaatgtttgtcccctccacaactcatgtggaaatttgtcattataacagtattacgaagtgggacatttaagaggaattatgtcatgagggttacacccaccttatgggtgggacgggtgtcattctcaaaggacaatttagctccctttgctctctctgatcctctctgcccttccttccatcatggactgatgagcaggaaggcccttatcagatattggccagcccccaatcctagactttccagtctccagaaatgagagccaatatatttctattcatcgtaaattacacagtctgcggtatgctgttttagcagtacaaaacagactaatacagtaatgaaaaaggaaaatgccaacataaaatcaataataaatacaaggaattctgaaggaataagcttaagcatattagttattaaaataaatacaaacaactgaattctctcatctaaagacagatgttaggtgagcacagcaaagcacagctatctactgtttaaaagaaacacccttcaatgataagatggaaaatgaagggaagggagaagggatactaatcaaatgcatttaaaaaaattggaaaacataaagttaaaaagtagcaatattaatgagcagcgagatgcaagggaaggttaatgggatgaatcaggataaaatgagacattaagtaatgataaaagcacaatttatcaagatgatatccagccgttaaccaatataaacctatctacatagcaactaagtatatatggcaaaacatattagatttataagagtttgttgcaaacataattataattgaaacctccaacatatcatttgtcatagttaaatagatctatatataaatatatataagaacacaaataaattaactaagactatgaatgccataaatagctgggaatttaaatgaaattcctgcatattagcaaagaaaaataaatcacagacaatggcagaaattataaaagaaagctagctagctaatatgttctggtgagtgactccttttatgggcctcgtttatttgtttcaaaaacatttccttaagtgtctctttctaattaaatcccattatgcacaatgatggactctgtatttagtccttattgatacaatactgctgcactctctattaatccaaatatacagaagatgttgggagtcagagtgcagtgctggggaaagggctaaccccggatgccaaaactggttttgagtcctgcccttgttatcactgatgcaatttaaaatctctgatagttgcagtatgtatcttgaatcccaaactggagttcaagtttgagatattacttactagttatatgatcttggacaatttacttacccttattgagattcaacattcttatataaaaatggagaaacaatctctcgggatgcaagtctgtctacaacttaacaacattttacaggatagtacaaaatagttaatctcctaggatccaaaacgcctctacaatcttttttttttttttttccaaataagaagctgtatttgtgttagaataactaaaagactgatgaagacagtgtttgcaaaataaaataatgctttcctcaaaggaacaacaaaggattaattaaatgagtattaaaaaaaaagtctttgcttctatttctcaaatttcaaaaaaataggttggaaatttaaagggcttcacaggccaggagtggttgctcacgcctgtaatcccaacactttgggaggctgaggccggcggatcacttgaggtcaggagcttgagaccagcctggtcaacatggtgaaaccccgtttctactaaaaatacaaaagttttccaggcatggtgttgtgcacctgtaatcccagctacctgggaggctgaggcaggaggaactcttgaacccgggacgcagaggttgcagtgagctgagatcacaccactgcactccagcctgggcgataaagcgagactgcatctcaaaaacaaatagaaaataaaaaataaagggcttcaagtattacatgcttgttttgacttctatacatgccagtagtggtgcctcatacaggacttggcttactgaatgatcaatacacattaactatcttttttcctttcatacctgggaataaagttgacgaagctgcatcattgctcttactgtcataaccactgatgttatccctactcaataagcccttcctgaagaggccagatgatttccttttttacacttatgtcattattgaaaatgaggaattggtgatctacaaaataagttgtgatactggaaggaaaacgccaatgtgtgcttatacgtgtaaggcacaaggggattaaaaacatgcctgggcaggcaaaaaaaaaagggtgtagatgttaaaaatctttataggagaaagacagaagttgtgggaaatggataaactggaaatagaaaataaaaaggaaaaaaaacaaacagaaaataagtcaatgcaacatttgtctcaaacctttgcaatatatgagggagaaaagtagatatggaagagtataaatattttaacaaaaggaaaaaatgaataaaatgaaaagatacaacacagtggatattttatctaccttgaatatttctgtgaaatcgaatcacaaaaagtactaagaaggaatattaatgcaacctaaacttaaagctaccataaatacatacacacatatagcacactgagaagtgagtagacctcaaacttaaagtgcataagattaaccctgggaatttattaaacatacagctcatagaatttgcatttttatcatgcactgtagctgattctgatacagattgtcaacagtctatagttgagaaacactgtctggttgaactatacttcaacattacccccggagagatgaatgtcctcctagtattttcatcctgtttcatgggtgggattatagactcaggacaacttagagaactgaaaatcatgtttttagctatgcagcagataccactatactctgaatgaatactctgtatcaagcagaacactcacgaggcttttttctaaccagtggattttggctacgagagaaaaagagatagcaaacaagcttggcacaagattcagaagaaaagagacttgaagcctccctggaagagaagataagacaacctgcaatgcttagaggatatttaatttcagcattctgaaatttggggaattataatagcagatgatgattatgctctccacagatttattaaaatacattttaaaaaaatgcatttttatgaaacaaatagagcttactttaagggatccctgaatgattattatttttcagtatcaaatagaattcaaagaagaaagctgtttaatgttcatttatgaaggactgccaaaaattcaaaggtagaagattctctgcttgaaaaagcagaacaatcagcacaaatggaagattttgagagtaatgtcaagacggtgtgtgtgtacaatatgaagataataaaacaaatacataattgtaagcattgcatataatggggtataataacttctaaatacttcatttctaagaaaaggatatccacttataaacgatataaatctgaagttctcattacataaattctgcagtagtttggttttggagttgtggtgcaaacagaaccacatagaatatacaaaatacgcacctactatgagcgagattgtgcttgtgcttttatcaattaagataatgttcagctgcaagagccagaaaactcaattaaaccatggtttgagtaaattgtgggttttgtttttctgaagttgtgggaagtacagaggtgtaggagtctggggctgttacagcactgcagactcatcagagatccagttccttaagttcttctcatctaccatcgtagcatgtggttttccaaactcatgcagctgccttcgaattgcaggaaggctgctctgtccagcctccaggctgaagaaagagggcacccagcaaatggcatgtggcaattaaatctgtctttagaaagagcttttctgaaagccccatttggaaattatctgctccagtcttataaaacagcactgtgtcacatgaccaccctacatggtacaaagaaggctgcaaaattcaggattttagttggctacgttgacactttgaatagatgtggtacagtggcgagtagatatcaagtaggcaaatagcaatgtctaccaaattagatatattatctaatttaattgttttacaaattacatgcatttcatttcttcaatagatgaggaactgaaacatagaaatgttaagtaacttatctaaggtcaaacatggttactgaaaggtacagtctggtatgaaagcccatataattaaatgcgaatatcttttcccactatatcacattcctttaggtaccaccaagccaaatattttcagatggtaattttcagaaaaatgtgtatatcatgaatacttcagtcagatgtattttgatggtggagactacatttcctcacctgagactgaaaatttatttagggcaccgaccatgtcttcaacacttttgcattcccagtgcgtagtccagggttgtatcagtagaaaccttgagatgctggctaaatgtggattaagaaattgtattttaagctcacagaattcgacaagattttaaaattttatttattctaatatcctcacaaggttcacagagcatgttatagagtaggcattgagtaaatatttgctaactttaaataagtaattaaaatttgattttattgcgagatatcagagaaacatatatgcagagaaaaaagcatgacagtaaaaggagtagtttgtattagagtcatgagtttgacacaaagctcacagggagctggaaatgcatgaatggataaattggcctttgctgcacttcaatatgatgaatttcattgagtcactaaaaaatatttgttgagcacctactttatatctgacattgtgttggatgtcatagatacaatgaataaaacaacacaaacacgtccttgtggcttaaattttgtcttctaaagatgtatatgttatgtcctgcccaagactataggaatccaactcttgcatcaaggtaacccagatgtgaggacatggattcaaatgagatcattttggagctttatgatttgactgccctgctggatttcagacttgcatggggcctgtagtcccttcattttggtcaatttctccaatttggaatgggtgtatttacccaatgcctttacccacattgtatctaggaagtaactaacttgctttgattttacaggctcataggtggaaggtacttgccttgtctcacatcggactttggactgtggacttttgagttaaggctgaaatgagtaaagactttgggagactgtcagaagggcatgattgtgttatgaattatgaggacatgagatttgggaagggtggtaggcagaatgatatgatttggctgtctccccacccaaatttcatcttgaaccgtagttcccataatccccacatatcatggtgggagggacccagtgggagacaattgaatcacgggggtgggttttcccatgctgttctcatgatagtgaataagtctcacgagatctgagggttttataaagggtggttcccctgcacatgttctcttgcctgccgccatgtaagatgtgcctttgttccttctttgccttctgccatgattgtgaggccttcccagccatgtggaactgtgagtccattaaacctctttttctttataaattacccagtctcagttatatctttattagcagtatgagaatgggctaatacaagtcctaataccagtaactccaattaccttatttggagatggaggtctttaaacaggtaatcaagttacaatggggtctttagcatgggcgctaatcgaatataactgatatccttatcaaaaggggaaatttggacacagacatgcacatagggagaacaccatgtaaagatgaagggagagattggggcaatgcttctacaagccaagaaacagcaaagattgccagtgaaccatcagaagctaggagagtgacataggacagattctgcctcacaatcctgagatggaacaaacactgctgacaccttgatttcagacttccaccttccagaactgagagaggatacgttacttctctttaagccctctactttctggtgctttgttatggaagccctagataactaacacacagtgaagcccctgcctcacagagctttacattctagtgtggagcagaaaaggaaatagaaaattaccagagagacatggttattctttatatggtggtaaattgttaggagtaaagaaaagtagggtgaggaggataggaagtgctgctttatatgatgtgacctctgataagatgccatcaggagtgaaagaaggtgagagattgagctttgtaaatgtctgaaagaagagcattataggcagatgcagcagccagcccatggctctgaggaagaagaatgtattttggttagaagaactgctaagaggttaatgtggctgaattggatggagtaagggagaggggaaaggtaggaggagtgtggtcagagaagaccacatagattgtataggtccattttagattctgatggtgactttggcttctattccagagatgccatgggagggatgttcaaagcaaagggatagtgtgatctgatttaagttttaaagggatctctctgggctgtgtggaaagataacataggtagggagcaaaggtggaagcagataaatcagggagaagccttctgtagtaaaaccatccaggtgagagaagtggttggcttgaaccagcttgttggttggtagaagacagaaggggctacgtgaacagttagacaaagcattgcatatacaaggaaatgcttgacagaggaatggagacaagttttctagaggatgcttcaaggagtttccacttaggagaagcaccttagaggggacattgaatattagcactggaaggaagttggtgcagaagagaatttggcttgctgtagccatgcagtcatccagagcgatgaggttatcaaccattacaagattcactcctcccactcatgtctttgattgacatttctggtccccagcgtgctgctctcacattttggtccctgcaatgagcaaatgaatttcgtttcctctagtgaaagctcaatttgaacaacgggggaaaggttttatttaaatctcctacagctttgaactcatcttggattcaccatccatctgtcaacctgaaaaaagaaaaattacttaaaacaaaaattcaaactgaattgacaccaaataaaatatcaaatgctggtagcaagaatgatccaataggaagtgcttaacagcatgaaagctcaaaaattggttgaaaaattatttgcatctagctgtttaaatattttgtttagttgccatacaaattaccttattttagactccaaattttttaagagcaaaaaaaaaaaagaaatttaaaaacacagaagtttaaaataaagtaaaatgtaaagataacatgactttgagttcagtgagattgtatctaattttgaaatatagtaagttaattaaatagcttcttaattttgcagcaggaacaaatctcagtctacaaaatgtggggtggatgtgtgataactggccatagacatactgaatttaaagggtaaatacttgaaacctatcacctgagtttgaatcccagcactttttttacaagttgaggaaatttgttaacccatgcttcagctgcatctctaaaatgggaataaaaatagaaccgactttataatattgctgtaggttttcagtgagttaagtcatgtaaagtaaatagagtgactgccttgattaagccttaaaaacttaagctgtattattattttttattatttaaatttcctaattttctatttaaagttacatttcactggcttagagaaaagtgtaaacacatttcgtttatctaattccagcttcctgggatttgcatcaaactttgggaagaggcatgacttacacagggcctaagcattggtgctcttggaggacacggagcttgggggttgggcagattctctgtggtattgacgatccttgtcttattttcttctcattggagcaggaggcagggaaagaaatgcatggctcagcagcagcagcatgcatatttattgctgaaggtcttctcccagacattttggatttttttccatttgttaccttcacctagaaaatctttagtgtattaatctgcagagggcatctggtcctttgtctataccatgaaatctgttattctgtacctttatttcttctgagctaaggattggataacctcaaatatttttctctctctctttttattgccaagatctcccttccctaaggcaatggaagaagacatacaggagagaaggaactacaaataagagagatcaccttgaacaaaagttcgaaagtccatgaagctatatagtttttttctttttgaatttgttcatatgcttgatctgtgccaggaattgtcctgaaatttatgatataaagaaaaattaagcaaatcatttaattaaattgcgtactgtcacttggagaagatgggcaagcaaactaatgactataataattagagtggagtgtgatgagactcagagtatgtagatataaaacattccacaaaagaccatttgtagtagtgaccctctgtagggaaagatatgcattccaacattggttttacttgaagtgagttgataaaaatgaagcttaccagactgcatatgagcaaggcgggactttggaattggaaagggaatgtggggatagcactggagaagcaggatagggctgcagcaacactgatcgacagggaacactaaacaaggtggactgttttctgtgggtgaagtctgcgtgctttaacaaagtaagatacttcgtatcttaagaaaattagcactcgtaagtgggagtcgaacaatgagaacacatggacacaggaaggggaacatcacacaccggggcctgtcaggggcgtagggggaaaggagagggagaacagtaggacaaatacctaatgcacacggggcttaaaacctagatggcaggttgacaggtgcagcaaaccgccatggcacatgtaaacctatgtaacaagcttgcacattcagcacatgtatcccagaacttacagtaaaaattaaaaactaataatagtaaaataaaatacagctattaaaaaaaaagaaagaaaattagctcacctctctgaaactcagttttctcatctataaaataccatcactagcaaggatgctatgaggatgagggaggaggatgtcattcagattcccaaacctataatacgtagacggtagtttcaaggaaggatgtggattctattcgtttgccttggtaatggctaagtgatgtaaaattagaaatttctaaattcatccatacgtagcttctgacatctgcagaccacatcgaaaaggttatcacactaacggggtgccgagtggagtaattatttccagtcaaatatcttgaaaatacatatagaaagttaccaagactagaggagaaggtagtgggagcatgagggtaagactttaaaatacctggattcaactgagttcccaactaattattagacaatagtttcctccattgcagtcaacccttcctgatttttttctttttaaaagaagacatttaaaaaatctttttattggtgtagtcacttgcatgatggcctggtttgactgaggtgttagaatagggtaaggcaggattttaccttcctccaacccactgtaggtgatttgcaattcaatgagcaataaattatataattccaaatatggagtgtgtgtatgtgtgtattttaatggacatcttttggaaatgcccagaaaatctggaaaattatggcgccaaagatggcctgaatgaaagcattagtagaaattagtataaagtttttgcttagtcttgctttggctatgtgggctcttttttggtttcatatgaattttaggattgttttttctagttctgtgaagaatgatggtgatattgtgatgggaattgcattgaatttgtagattgcttttggcagcatggtcattttcacaatattgattctacccatccatgagcatgggatgtgtttccatttgtttgtgtcatctatgatttctttcagcagtgttttgtagttttccttgtagaggtctttcatctccttggttaggtatattcctaagtatttttttatttgtatttttttgtggctcttgtaaaaggggttgagttttttatttgattgtcagcttgattgctgttggtgtagagcagtgctactgatttgtgtacattaattttgtatcctgaaactttgctagattcatttatcagttctaggcattttttggatgcatttttagggttttctaggtatacaatcatattattggcaaacaacagttttacttcctctttgctaatgtgggtgccctttatttctttctcttgtctgattgctctggttaggacttcccatattttactgaatagaagtggtgagagtgggcatccttgtcttgttccagctctcagggggaatgctttcaacttttccccattcagtatgaagctggctgtaggtttgccatagatggcttttatgacttcgaggtatgtctcttctatgccagttttgttgaggtttatacttcccaaaagtatacctacaatgagaaagaaaattggtgggattatgtgaaaagattcaataagcattcacttgccatatgctattggaaaggcactagaggcggaagaaaatcacagttcacctaattaattatgatatagatatattgctactagttataatccaaggcataataattctacatgctaaatggagatcccatcatcattcatagaaaagtagagcaggtaacattatttcaggaaatcagggatagcttctggaggaattaggccttgaaagatgggaagagtttgttagaggaagacttgggagttcatcaggaaaaatatttaagctaatggaatggcaggaacaaaaagatgatgtgtgttgtgtacagggttctatttcggggagtgtgagcagaacagaatgcttggagttttggggaaaaggggagaaagggtgttctttattttttgttgtttaatctttcagtgatttcctatgaaagaactttaaaatgccagataccttctgcatttgaagaatgattttttttcacataagcagacaccattgtgtaaaacaaaatatagtaaacaaagccaaccaggctttaacgatggacaagcccgacttccgaagctacagtgccttgccactaaatatgagcctgacttgaagagtagttaacaaaatcattttttaaaaatgtgagttcatcttgtcttacctcacacagtttcttgatggtatcagttgctgcctaatttcctgagtcctaacctaagagtacctcctcctggttagggtctcaacttgccttcttagaatgaattcttttcactacattctcaccatggatcttctcttttcttaagtcatcagtaaagagattttctaccatatccactacattacagtatttggctgctctagatgaatatcttgggcagttggtccaggacttacaatcctctaccttgatcctttgggtagcctttctgtttggttcctctgtcttagacagatgggcaggagagggttcctcttctagtatcttcatgtcacaaggtgttatccatgacgggaagtgggggtgagttgtctttggcgtttctttagtggagtgcagctcagagcagtgtttcttaaaatatgtccatcattttgtgaagtggtattcgtcatgatgatattgcaatttaaattcagaagtgtgaataaaagcatggtattaaaacaatttatgaaccaaggcttcaatcattagtatgataactgcaaacacatatataaacacatggctgtttgccatgtaatccttctttcttttctttcatttctttctcttgagtagactttcccctattttattctaacccttccatctattaaccgtaaactcgtctgtgtgtcttttttttaaagagacagtgtcactctgttgcccaggctggagggcagtggcactatctaggctcactgcaacctcgacttcccaggctcaagccatcctcccacctcagccttcctggtagctgggactataagcacacaccaccatgcccggctgattttcgtattttttgtagaaatggagtttagttatgttgtccaggcaggtctcaaactcctgagctcaagtgattcgcctgcctcagcctcccaaagtgctaggattgcaggtgtgagccaccacgtccagctgtgtgccttcattgatactaatgtagattgaagctgaaaagataggaataaaaaaaaaacccagaacatgtggcagctattacaaagattgattaaattgatgttgttaaggggaaaaacccttaaatagcatctatgatagcattttagtgaccatggaaaatttaatattttttctgatagtggaccacttactcaagtgaatcctaaattatatacaaaaattacgtaacaaagacagccatgagttggaccctgttggataataatctagtgttttctagattccagaattgtagattcaagtgagtagaattggaatgtactttgatttgggggagttttctggaaacaattgtggatatcgtttttcaatattgaatgagttgccaccagaggtgtcatgttgcttggaatcatcaataactcagaagtgacagagaacagcctgggtatgctctgaaagacatatagatgtcacatgttgagagcttaaccagatggcatttttactcatgcaataaatacatattgagtgtccacaaaatgtcagactctgtgatagggtggagcaatgaaagagtgagaaaaagaaacaactacccttcagtcctgggatttgagattttttcccatcctaggaatctaggaatctacaaatatgaccttcagttttacacagaagcttctttttttaattgttaaatggggctcagttgcactactttacagcctaattttaaaaattagataaaaggatatgtgggctgggcacagtagctcacgcctgtaatcccagcactttgggaggccaaggtgggcggatcacttaaggccaggagtttgagaccagcctggccaacatgggaaaaccctgtctctactaaaaatacaaaaattagctgggcatggtggccgtgcctgtaatcccagctacttggggggctgagacaggagaatcacttaaacctgggaggcagaggctgcagtgagccgagattgtgccattgcactccagcctgggagacagagcaagactctgtctcaaaaaaaaaaaacaaaaaaaaaaaaaaaaagaaaagaaaaggatatgtgtagaagtgcccagtgacaaaatgcaagaattttagaaagttgataaaacatgagaagatcctgggagacacatgtgaatctcaagagcaggaactctagtgtattcacctgtacacagttactatcactagtgacagaaacaatagagaagtattttctttctgaatgaagaattcttctctataatggtaattcctattaaatcctttaatcggtaattgcaaaaatggaataagatttcagtctaatgctccaagatgtttgcactgcaaaattctacccattatttagtcaaaatccatctctgaggagcagcctaagcaaatgatctctccttaacctcagttgaaaccttgtcatgctatttcactttgcttagcagagtgctcatcttgagtttgctgtataccaatatgggggtgcagtctccatggctgcctgcttctccccatcctttgatacaaatcaacattcttgtttagagaatgataagagattattaaattcaggtatcagcagtggagttttggggaagaaaaataaagagatcatgctctgtaacacagccctgagaaaggagactggggctgtgtgctttctagaaaagtggttttccctcctgcatgactgatggcctgtctggtgtgaggctgaccatggtaataatgtcgtgacctactctccacagtggaaaaagctgtcggttctgatgtgatggaggttgggtgtgggagattgggattacagaactgcagtggccacagatagactcctgatttagtcacataaaacaggatgattttgtgtaaaactgacatttagtttattttacatatatggaaggaagactaggaagaacataaaacaattagcaggaattacttctaagagatattgagggaagtatcaatttcttttgattaatatgattttttacattccactttttatttgtgaagatgtataaatctaaaattaaatatacatgcccacaaaaataaaattatgtatttagtgacttagcgtaatttcataaagggagcatgaagtttagaatcagccctgcaattaacatcctaaattttgcactaaggataaaatgcttgaaaaaggatgaagtgataatatccctttctttttaggacagacattctaggattgaacacagctcctggaaaggagcttttctgcctcgctcaccaggagtgtgctcacactcttgacagttccctgtgctcctttcccactgtgggatttaaggccaaagagattggatctggctgccacactccttcctgctgccatattctcttagtgaccatcaaatgtcacgtcccttgttgacacagcactatgctctggaagcctttgttgaaccctattccgctgtcctttgacccttttactttttgaaatgtatatattctgtggatcccatgttttgttttctagcctgcagcttccctcagcaactacagccagagccagccccattcccttctcccctcctaatcagaactcttaaagtctactccagtctttcttagcttgcctgttttgctgtaataaactgggacatgcagggcaaagtctcaacacaggacatctcagcatcttgtccatactcttatctcggagcaagaacacacggacccactgttgatacctgagacaattatatttctttacaatgattttagaaactactagagcatgatgagctcaggtgttatggttagcaaatgtggaagactcaacttgccttcctcacaaaacctatttgctcttctcagttgcaatggactacctctacctggagtgtcaccagtgaaaaagttacttgacagggatctgtgggtggaatctacagagtgacagatttcagttcagttattaagataaagcatttataactgacatgttttgtaattgagtgggtggtttgctccacattcctatggcaagtatttcccagagcaggtaccttatatcggtagtcccactgggggctccatgacaacgcagctgttttcatcaagttggaaacgctgtcactgaattactgcccatggactctccacatacctaggagggaattgggggattcttgcagcagagaagcccatttaacttcaaggcagtagtctaacttttttttttttttttttttttgagacggagtctcgctctgtcgcccaggctggagtgcagtgacacgatctcggctcactgcaagctccgcctccccggttcatgccattctcctgcctcagcctcccgagtagctgggactacaggcgcccgccaccacgcccagctaattttttgtatcttttggtagagacggggtttcaccgtgttaaccaggatggtctcaatttcctgacctcgtgatccgcctacctcggcctcccaaagtgctgggattacaggtatgatccaccgcacccggccagtagtctaactttttaaaacacagatcaatattttcctggaacatgcttttccatatcccatagaccagggtttaaatgatcacacttgggacccttgtatgatcagaatcatctcgctccgttacttttagcacagggctgatgcttaaacccacattgtgtcgctttgtcccagggctgcattgcagtgagttcctgttcataggctgggtgacaagttaaaggtggcatcctgagattggaatcaaggcaacgatgttttcgcttgctctgttgcagcctgcccacctcgggggaatgtcagcagcccctttttgtcagcatataaacaagaggttttgaattgttcagtcatagagaattgtgaatgcgttagaaacacccaggccttaaacttcggttagtggttagataagaagaaaaagttcaagggaactattgtacaatgcggcaactatagttaataacaatgtatttgctaacagaatacattttaaatgttctcaccgcataaagataagtatgtgaatgcgtatgttaattaacctgatttagccattccacaatgtatacgtattccaaaatatctggttttacagcataaatttatagaatttttgttaattaaaaaatgtgggcttcaaatttccaagtgttttccaggaatttttggtgttaaaaaaaaacattcattttgtcttgctagacaggtacctagtcctaaaatcttaagaatgtttcagctctgcagcagagctgctggcatttattaagtatgttgctagttgtaagatcatttggttcaatgttgggcatattttcagactcaacaatttatattttgcttgctgtatgtgcaagcaaataacttcaactaggccagcctcgttgtgaagaaatttccccggtaaccaatgaagaaatattaatgatttgccagttggtctcctcggagacagataacagttgtcttcctttgtctgccccgctacctagcttatatttggcacttcatcaataaactaggggtgagaaagtaaataagtggtgcttctactctgcctgaggatacttgaaagcaacttgttctcttaagtggattaaataattcctccctgaagatctcattacttgataattttgtaaaaattagctttttctttataggaagggggtaagtaaactttgagtataactggtagctaagagccaagccggcctaggctccatcatgttcccagcacttatgggcaatctggtttagagaaagttagttcccctctccgtgcttccgtttcttaccagtaaaatgaacattacaacaatcttataaattgctgtgagataatatttaaagcagttcctggtacgcagtaagtgctcagtaaatgttacccactactgtataatccaaaggtgggagtgttccaaaacaaatgctaattttacaaataaaaattttggagtgttaaaaggaaggaagttatatgttcaaacatatgtatgtcatagataaaatcaaactgtttttgcttaaactatgtgcctcttcttccaccctaatatctgtgcagtacttgacacatagtttgctgagtgaatgaatgaactattaattaattaatcttcacctgtatcgcttgatgttttcctgcaggcgtgaatatccctgggcatactgcttgctttgagaaatagccagtgaagggttatgagaaatagtgcgatttatgatctgtgtatgactcaaatgacaaaattaattgcttttttgtcatctgttcttcatggattttcattaattcttccatatgaaccaaatcctgtcttaaaccctgcagtaatgatcacggtgtttaacattttaataaaacgatggaagcatgtatgtgtgtgtgtctgtgtgtgtgtgtgtgtattcatgacaaagaaagtgagagagagagaaagaaagagaaaaataatttacatgagagttaactttttatttgtatgtccagtggtgtcagttgccatgaataagctattataaaaaattaataaataatttcccattaaaatacaaaaatataaatgccatcttccttgagagtatttctgaaagttaaaaactctaataattggataacttttctgttatgttaaaagaggacagtttttctttcccttaagaagattcctacttatcctattcagtgtttgaataatttccaaattttgatttctgtctctgctactggtcataaacatattgaggtttcaaaacattcagattggccctccattaatcaaacatgccactcatttcttagcacaatctacagattcacaaagcccgatgctccatatcccttgtcacatccggaggcagagcattgaagttcatggaagaaggaagaaagccatgcctgagttgcacctgccagcaaaacagatgacaggcagccaattctgagccatctcagctgcaccggaaagttcttgttcaaacaggctgtatctaaagactttctaattaccctctcatgtcatggaacacctgtggtccactgtttgagatcctctgctccctgatttctgtacacttgcctctcctggtttccttcctgcaacctcctcttctgtctatatgaaaaagtttagtttttattcccagctgttcacaaatattatttttagtgtaatgataggtaatccttattttaaatgtcacaactctagtctctctccaatgtcctaggtaccacagtcaggaagcttcctatttgcataagaatgaaaacatggtcttgaggcaggataagtaaggttaggacccatacttacttgtcctgtgtgtaaagctcagtgggccacttttatagctggctctttccccttgcaccctcaggcatcaacacctaactcttttgcaagataagcggtcctaccgaataccaacagactgttagatggttacaagttcctgatactcagtatgggcttggggaagagaacaaaagtctgttattcctgatgtaacttccccagcaccaaaagcacaagaaactattagctacaaatttctgcctgctgggcactgagagaggggcagagactcctccagtgtcccacaggcatagctagactcaaggtttagcttatagtaatatttttctcattttaatatcaaaaaacaccccttagatggagattttatatgctaatgatacatatgatatgtgttagagcatgtagatcctgagtgtatgtactaaccacagatccacctttacatacttgacctcaccagtattttatgaatatgtctgtacagtttccgtaaaggaaattcccttcaagaccctaggggctatctctgtctttgagcagcccactctgcctctcagattttgagagctaatcccaagtaagagtagacaaacaagtttgttgcacctcactttgcaatactttcgctttgatataaacttctttgtctacacttacttgggattcgctctcaaaaccttttgtgcagagaagtcaacgacctgaacaaggctactgacaatagtcttgccaaattttctacaaactccattcttctttatttttattttattttattttactttaagttctgggatacatgtgcagaacatgcaggtttgttacataggtatacatgtaccatggtggtttgctgcacctatcaacctgtcatgtaggttttaagccccacatgcattacgtatttgtcctaatgctctccctccctttgccccttaccccccaacaggccccagtgtgtgatgttcgcctccctgtgttcatgtgttctcattgttcaactcccacttatgagtgagaacatgtggtgttcagttttctcttcctgtgttagtttgctgagaatgatggcttccagtttcatctatgtccctgcaaaggatatgatctcattcttttttatgactgcatagtattctatggtgtatatgtgccacattttctttatccagtctatcattgatggatatttgggttggttccaagtctttgctattgtaaatagtgatgaaatgaacatacatttgcatgtgtctttatagcagaatgatttataatcctttgggtatatacccagtaatgggattgctgggtcaaatggtatttctcgttctagatccttgaggaatcgccacactgccttctacaatggttgaactaattacactcccaacaacaatgtaaaagtgttcctatttctccacgtcctctccagcatctgtcgtttcttgacttttaatgatcgccatcctaactggcgtgagatggtatctcattgtggttttgatttgcatttctctaatgaccagtgatgatgagctttttttcatatgttttttggtggcataaatgtcttcttttgagaagtctatttatatcctttgcccactctttgatggggttgtacaaactttattctttgtattgcacattctctccctcctaggagcaagtttatgggtccatggcctcttcatccagtgcacattttctgcttttccattatagcacttattacaaagaatgaccatagctttttctccatggtctctcattcatttctgagctacctgagaacaagaatcctttctttacatgaaagtgtgcctgatatctatcaccatgtgtatgatgaccacagagtaagcagtcaagaaatgccagggaaataaatgaatgcatctactttttagaaacattgtcaccatctttctttatgtaattaaatgtgaacggttcataaggcaaattgataaggatagaaagtagattagaagttaccaagggctgggaggagggatgaatgaggaattatggattagggggcacagagtttctgattggggtgatggaagaatttggaaaaaaggggtggtggttgtacaacgttgtgaatgtatcaagttaacaaaagtaatggcaaaaaccacaattacttttgcaccaacttaataattaatgacactgagtcatgcacttaagcatggttttaatgataaattttatactatgtatatatatatttttttccaaataaattttttaatgacctatttacaaacacaaaaggcattgaaatctgggtaactagatgcatgttttctaaaaggaaaagcttatttgctaaataaagaattcataaaaggaagctcagcaattagtcttggaaacaattacaatggtagcaatagttttttcccttattctcacttcagacaaatattatggcaacagaaaaaaatgttaattaatgcaatgaattttaaaagtgaatgagtgaataactgaatgattaaaaaaagaaccatttaaatagaggaacatctgaggttgaatacttgggtccagcccagtacagttcattgctctgctgatcaggcagatgttagctggtcaggatggtttgcattctatatgcacgtagaacagacatggacacacatatttgtgtttggtaggatgggctgtcaattcgaatagtcatggggcttaacggtcagatcaaccaaattggtgccctggaagtgtctcagattttgtaacctatgtaagagttttaatctcactgaagcacagttttctcatctaaaaagtgaaagagagagagaaaaaagtccaacatcattgctttttttgtggaggtaaagtacacctgattagggcctggcatgcagaaattccttgcttattcacttttatttttattatagaggttcaaataaattcatgttgaacaaatagttattccacataaaatattatgcattctgaaaagaatattagtgccagatgttcatggtataacaatttttctttttctttcttagctaaatttatacttagcattcttcatgatgtatgcaatattagttcatctaaaatctaagctatagctcagaggctttgggggaaatactcatcagtgttcagagtaactctactgttggtgatctgtaatgtatcttttctaagcaaacataggggttaaaattgaggctgtgccttgccttggagggttagtcttatgagcactgatttccatgtatagagctttttctaacctttttctctttttctcttccccttccttccatgctgactttggtgtagcagaccacttggggattgaattcatgggtaagactaaacaatttgctcatttaatatcctggaaatgctaagctttatgatgtacatagtgctttccttctccatctggttataattgaaatgtctcattatcagatgctattagtaggaaaaaatactcttgtcgagttttcactaagtaatggctcaaaatgaaataattaactacttattggaaaggcaatttaatgttaaatgcagtgtctggaatcatacagaagttgtatttggctcctggctttgattatttcctctaattctcaattttcatatctgtaaaatagggataataataggttctattttcctgcacatgtaaattgcttagcataacgtctgcaacatggcaaacactcaataaaggataaaaagcaatggtttttaaatgtcagtttttaaatttttacttctaagtccccttccttttgtgagatgattcctttggatacattttggtatcaattttagtttggagtgtgggctattaaacatttttattcacaaaattaaaatgtttcctttaaagtatttgcagtgaatggtgtatgtttcaaagcattagaatgccttccatgggcattgtttttatagtcacagataactgcattcaaaattagacctaattctctgagtcgatggttatacattaaatgaagaaagaacatttcataaagttcaatatgcatcgtagtacatggatggaaagacactcaggatttagagttagggaaattgagaagatctaaatttgaatcaaaattcatctgcttctttggattctattaaattcagatttttttctcttgtataatgtggatatgaatacttgctttatacatgaatgtttattgtgaaataattatatacttacttgtattaatttatccattcacccattaattcagcaaacacttatcaaagtgttgatttgggatagctttgacatatttgagagacgttaagttggtggttgtattgttggaagtgttgagagttaattagaaatttgtgaaatgtctttataccggaattggtgttcccagttgtatggtattactcattattgctccattctctggttattacatcatagaaaaggcagacagctcaattcctgcaggcttgcggttttgttggatagatgtgatgaaaactcagaaaaccaatgagatttaggatgttattcaaatgaagcgcgatggaatgtgagatagttgtagaaggaagtgaaagaagaatgaccgtttcaatgaaatcaattagtagtcatcatgagagcgcttgaacaagctggtgtgatgaagagattatagtcatatggcagattggttgattttgattttgaagatggaggagttataggagatgacaatattcaaagcattcctatgagtgtaaataaccaaactgaggttgagggggaaataatttgaaactagaggtcaaggacttgagaggacatagttttggataagttgtctaatggatattccagttactcatgataatgctagggttgggacagagagaaaaaaaatgttggttatatgccaaagtttcccattaatatgataaactatactggaatttagtagatgacaaggaagagtatagttaagggtaatgccagctgcatcaaaaaatagagcccacgttattataatggctcaaagacggtagcaatttatttcctgatactactttttcttgtccaaggtagatgtatttcctgtttaaggtagcaaatgactagttttattcaagtagtgaattagagatccaggcttcttccatcttttggtttcaatattacgtaggtttctttgttaactgcatctagccagcagattgagaaacagaacagagctgatgcatacccaatgcttaaaagactgatctacaagaactcatatcactttttgcttaatgttctattagctagagctaaattacatgacttcattttgctgtaaaagaggctgggaaatggaaccctgagagaacagaggaaatgcatttttagaaatctctgccactgtgtgaatggcataaactttaaaggaacaggatttttcataagagacaagagaaactgtacgttagaagccaggaggacagatctccaatgttgaaagtgagaaaataaaaacagctcttgagacaggtagaggaaaatgagacttttcaggcaagattcaagtttcagctaaaataggagaacaaaaataaagagtcaaagaagagattgagaatgcagaaggtgtgttgcggaatgtggatgagcaatttcactaagccaagtggagggtataactggtggaagaggagtagatagctgagtcatgggccacaaattactgaaaatcatgggcatatttttgcagtaagaatacattgttgagaagggcacacaatttgtaccctcctcattcgctaatgatggcagtgattcgtagcatggaggtgtgagcatcagtactcattttgaataaaatgtgccctgggccgcttgtccaagagcaatttgccccactagtctgtggtgattgcaggctcagtgaggctttataagttgttcagcagaatgccctcaaatgcaggaaacactgcatagttggtggtgggactaggataggtctagatccccagtgtagccatggctgtagcaaactaaaattgccatgcaaattttaatccgtgttgaaagaaatggaccagtctccatcctgttgtgcttcctattgtgtctgaggactgccagtggcactggtaatttatagagttataatttgctatagatgcaatctatgtattaagagctctgttttggaattcatttaaagaaatgtagctactgacacaggaaaaaatagtagattgtcatgtagttcatctacatgaaccacaagactaaggtaatagtgagttttgcaaaagatagattctaatcatagctataagacctcatggggaatgaattctcagtgggtgactatttgactccaacggtagaaattttcttggagggaaggggttggggaacaactcagagttcaagggattggctggtatgcatatagataatggcagctaaaaaaggattgtttgcagtagtgaatagctttataaatttagtgaatatgctgttttcactgacctcaataattcacccccacagattgttctaattgaatatgtaaaattctgtttgttgctttgagaacaatattctcagatttaacttttttatttttattttttgagatggagtctcactgtattgcccaggctggagtgcagtagcacaatcttggctcattgcaacctccgcctcccaagttcaagagattctcctgcctcagcctcccaagtagctgagattacaggcgcctgccaccacgctcaactaatttttgtatttttagtagaaacgggtttcaccatgttggccaggctgttctctaactcctgacctcaagtgatctgccctcctcagcctcccaaagtgctgggattacagacgtgagccaccacacccggctagatttaatttatgattatagaatccatatgggtaaaattccttccactgaaagtgccatcatcccaagtaatatgacatctctaggtatgaattcagctgggaaggggaaatgtaggcatagtctatatgtaagtttaataatgtcagtttattgttgtgccaacaattaatcaatgctagttctatttgtgtgtgtgtgtgtcaatttctttaatagacttgattttcacacagttttaagttcatagcaaaattgagtgcaaattacagagatttctcacgtatcttctgtcttcaaacatgcacagctacctccctaatgaagatctcctacaatagaggtacatttgttacaattgacaaacctaaacctacattgactcatcattatcattcaaagtccaaagtttacattatggttcattcttgatgctatactttctatagattcagacaaacatattatgatatgtatccattattatattatcctacagagtaggtttactgccctaaaaatcatttgtgttctttctagtcatccttgcctttccccaaccactggtcttttttatttattttattttattttattttattttattttattttattttattttattttattttgagacagagtttcgctctgtcacccaggctggagtgcagtggtgccatctcggctcactgcaagctccgcctcaggggttcacgccattctcctgcctcagcctcccgagtagctgggactacaggcacccatcaccatgcccggctaatttttcgtatttttagtagagacggggttttcaccgtgttagcccggatggtctcgatctcctgaccttgtgatctgcccgcctcggcctcccaaagtgctaggattacaggcgtgagccaccacacctggccccactggtctttttactattgtcatagttttaacttttctagactgtcatatatttgaaataataccttttgtactggcttatttcacttagtaattttctcatgtgttttcattgcttaatagctaattttttgtatttttagtagagacggggtttcaccgtgttagccaggatggtctcgatctcctgacctcgtgatctgcccgcctcagcctcccaaagtgctaggattacaggcgtgagccaccacgcctggccccactagtctttttactattgtcatagttttaacttttctagactgtcatatatttggaataataccttttgtactggcttatttcacttagtaattttctcatgtgttttcattgcttaatagcccatttctttctagagctggataacattacattgtcaccttttgaaggacatcttagttgtttccaacttttgacaattatggatataattgttgtaagcatctttgtgcaggcttttgtatagaaataaattttcaactttttggtgtaagtaccaaaaagcatgactgctgggtcatatgggaaggatatgtttagtttttttagaaactgccgaactgaattccaaggtggctgtgccattttgcattcccaccagcaatgaatgagagttcctgttgctccacatggtctccatcatttggtgttgacagggttctggatttgggtcatttcaataggtatgtaatggtaactcactgtttcaatttggacttcactaatgacacttaatgtggagtattttttcatatgcttatttgccatctgcatattttctttagtaaggtgtctgccaaggtctttggcccattttttaatcagtttgttttcttattgttaagaattctttgtatttttgaaaaatgatcctttattagatatatcttttgcaaatattttctgtcattctgcggcttttccctttattctcttgacagtatgctttgcaaagcagaaattttcaattttaataaagtccagattataaaatcttccttttatgtattgtgcctttaacactgtatccaaaaagggattgccaaatctagtttatctaaatactctcatatgtgatctgctaggagtgttatagttttgcattttgcatttaggtctgtggtttattttgagttaatttttgtgaagagtgtaaggtctgtgtctaggtgcatgttttattgaatgtggatgtcaagttgttccagcaccatttgttgaaaagtttatcttttctccattgtattgtcttttctcctttgtcaaagatcagctgactatattaatgtgtatctattctgagttctttgttctgttccattaaactatttgtcttttttttttttgccaatactatactattttgattactatagctttataataagtattgaagtaaagtggggtccgtctttcaactttgtcttttaatgttgtgttgacttttctggatctactgcctctccctataaatgttagaatcagtttatgaagatacacaatgtaacttcctggaatttttattggaattgcattaaatctataaatgaagttgaaaagagctgacatcttgacaatattgagtattcctattcacgaacatggaatatctcttcacttacttgggttttattttttaagtctttcattagtgttttatcattttatttgtatacatcttttattttgctagacttatacctagatatttcattttgggggatgctaatgtaaatgctattgtgtttttaatttcatatcatatttgtttattactggcatctaggaaaattattgactttacatgttaacctagtatcctgttacattgatataatcatttatttgttataggaatatttttaatttttaatttttgttaacctaagcaatcaggtcatctgcaaagacagttttacctcttccctttccaatctgtgtacattttgtttccttttcttatcttatttaattcgctacaacttccagtatgatgttgaaaaagaacaatgaaagggggcaactttgcctcgttcataatcttaatgagaaagctacaagtttcttatcattaaaaattatattaggtatagatattttgtagatattcttcatcaagttgagaaagtccacctctatttctagttaactgagagtttttaccataaatgggtgttggattttgtcaaatgctttctttaaatctattgatatgatcgtgtgatttttttagtctcttgatgtgatggattacattaattattaatattgaaccaactttgcatacctgagataaatggataaatgtcacttggttgtgttttccattgttctattttaattagttacataatacattttttctcttacttttattattcttgctttgagcaatatgactttcatttattcttgaagaacacagggtcacaaggaggtaatgatctgaagcacacgtcttcttcccaaatctttatactctcaatgaccagctctattagtgagcttactgatcagtctcaaaaccagaatacttcatacagtttaacaaattcctgttttatagcaggaaactccaagtcatatgctgcaagagttctatatttaattgacatacatttgtcacatttactatatgccagatgtataagatgttggatatgcagatatataatacatatctctggatgtccaaaacctctaaaactaaaaagagaaagctacacataagtgaggtgacataataagtgctctaaaaaaagtttaggcaagatacgatatgaaaaaaaaaaagaaagcaattgaatgggcttggaaagttcaggaacagctttccaggaaaggggacacttaagctgagtatcagccaaagtggataagctatacttagtaatgccatagtgcaaatctataccggccccatattgctcccacattaaagcaagacttgctatttcagtctttcttcctgtatctatcagcttccgagagtcaccactttaggaccggaaagaggataacaacttcagtaaaaacaagtaaccaaaaaggtttttgagtagatttattaattttaaggagtgattatcccattgaggaagccatgccaaacctaatgtctgtaaaactgtcaacattcaacatgatttttcatttatattcccgaatttttcttaatgatgctcctgggattggtaccatggaaatttcaacagcaaatactgatctgcaatacggtgtcagttaaaaaataaagttaactgacataattagagcagaaatttggaaatgcacacagaagcagaattgtgtttgtgaagtttttgaaacaaagagagttgatagaaaatcagtaaccaaaaatatatatcttaaattcatgtcttaacctcattcattcattcatgcatgagggaaaatatagatttttacagtcagatgtttgaaatttccttaacagtttgaatagatcaagagatataattgacagacttcttcataagcctaaatattcatgagtgatgtgagaaacaaccaatcatttagtttaggcagttggccaaagggcatgtcagactggccattttggaaggtgcaataatcacgaaggatttcttatctaacaaatatctagctactgtgtgtgaaatgtatctcattaggtccttttgagctatttgttaagtggttatttttctaacaatgtcttgatgcatttgatgttccaggcatcaaagatgtttatatgaaagcaggtgcaatgccatttgaaaatgtattagcaagggacaagtagagttgaagattatgtggaagatctttaatgcaaatttccttcattctcatcgggtaaacgaaatgaatgctgtcagttaaatattttgtcggtgatttgacattgtttttaggatagcataatatatttatgcaaagtattgtttgagcaaattctggtgtaattttttaaatcaaaagatgtatagaacatagaaaaataagattcttaattaaaatcttaaaaagttattataagataatctttgtattttttaagttaaaaaaaaaaagaaacagtgttttccatatggaaggcatagaaatgtgttgtactcaacgtctgtgatataaattatatttataggtttagaattgatagaatattacttcaaacttgatcgtatattgggtattctttcatcctcttgtgtaaagaaaataggctttagtgtattttagtgagcactggggataatctcctaagaagtgaccagtttaggatcctgtttagatgataggaagtgggcttttttcttcttagagctaccctgcatattgtaaatgacttggtgtttttcctttaaatctaacaggctcatatgtcagccaaatgaattcatatttctgttctagtttgtgaactggcgttagagatagaactgaggattcttttttcctaagctgaagtctctgaagtagacttatttggaaaaaaaaaaaaaagcattttcattcatttgaatatattatatttctgtatagaataaaatggtaatttatggatatatatgcatagatgtgtgtttgtggaggagtgccattaaaagagtttagttttgctagtgtgccctttgccatgttaaactacgtgagaaatcagatatagtggaaaaacaaaagttacatgatcctttaagctctcaaaatgagtgaatgaagtagtaactatttatatcgctatcttacaaatgacaaaacctgactactaattagctgaattatctttctaaagagcaacaaagtagcagataggagttgaattcaaatctgtctttctccagagctcttgaattatttaggtgactaatggatgagcaatagggctccatgtttcctcaaagaggttgtactcttgcagtgtttcaaatggcaaagcagttctgtgactagtccttagttttgaaggtaatgttttctgaatcccttcatgtcataaggatcttggccagtaactcacaattatccaagctacaagcaaatgaaatatgaaccagatcctgtttatagctatatattcagaattataactgccaacagtataaaaaggaccacttagctggtcattgtattctctcacatggggtaatctacagaagttgtattgtattgaaggttttgtggtgagtacagactgtgttgaatgaagtcatttgggtggttctactgtacatgccattggggtataaaggccttactcatttatctcctctgatagaaaacatttgccaaattaaatcatgatttgaaccatctctccactggctcctaaagattctattggagaagtatttaatacttacacaatattgttttctcatttattttattttaaggaatatgaccactctctttctattttttatttttcaaggcagggtcttgctctatcaaacaggctggagtgcagtggtgtaatcgtggctcattgcagtcttgacctcccaggctcaagtcttcttcccattttaacctcccctgtagctgggaccagaggcatgtggcaccatgtgcagctaattttttatttttttgtagagatgaggcttctctatgttgccaaggctggtatcaaactcctgtgctcaagagattttcctacttcagtctctcaaagtggtaggattacaggcgtgagccaacgtgcctggcccactctctccctttacactttgattttctgttggtttattttaacatgggcttcagtacatgcgctgttaatcacaagccctccaagtattttgttttaacaaagttatctttatttgacatggacattccaaagactcccaagccatacatataaggataatattttggcttaattattaagagtagtcattaacacatattggtacctcctattgggagaagtaaaagtgtttacacaaagtcatgacaactaagtcaaataaattcaattctgagataattttcgggtgagattaatagtgttcagtgatctttgaaaatgatacaaccaaaagatgtattgaagaagtatgcagatctattaatcatgatttctacaaagaagaacatgagtatttctgtaaagatgtttttggacaagattttaaaatcagctaataaaatttgattggtagacactgaggaaagtattgaactattggcaaaagcagtgctgttcactgaagaataacataagaccaatacatctttgctagattaatagtataatattttccgtaaagttgttaaataactagattggaagtttctacgtaggtgtgaatatatggactttagcaaaatcttgggcagaatttcatgaatttcttatgtaatatggtgaaacattaattatgtagtaattatatagtgatagatagatttggggcaatgaattctagttgaaggatcaagaccagccatgagcagagcttctagtttcttctaaggaaacatttttatgaattgaaataagggtatagcttgaacatttaccaaattattgaactttttgtaaaaagtgaatgcttctttgtcagagagcaagtctaacaaaaagcattggacattggacttatcaaatcagacacagaataatctgatcttttagtcagtatcaagttgattacttacatatgccaaatatctcaactgcacgtgagttggtagtaggttctgaaaatctgggatgtgctaaaataaagggaaataaagagcaacagtgatgttcagattgtacttagaaagtaattctcagagagagccaggcatggtggctcacgcctgtagtcccagcagttgggaggccgaggcaggtggatcgcttgaggtcatgagttcaagaccagcctgaccaagatggatgaaaccccgtctctaataaaaatacaaaattagccaggtgtggtggtgcatgcctgtaatcccagctacttgggaggctgcggcaggagaatctcttgaaccctggaggcagaggttgcattgagccaagattgtgccactgcattccagcctgggcaacaaaagtgaaactctgccaagaaaaaaaaaaaaaaagaaagaaagtaattctcagagttatcagagaagttaaaaaattgttttttatatccaattctgccttacagttgcttcaggagctaggataagtcagcttaatagaaaggggaagaaaggacaatgatggaacatctgcagatgcagcaaagtgaagatgatacaggttcttctcaataagcagagtctgtctgctttgtgggctcatgatggttcagccagtcagaatgtgttgagcccctgtgagagctcaggccttgtaccaggccagctacaataagtcaaatgagacagactctcaagaagttcacagttcagtgcatagggcagactttttttttttttttttttttttttgaggcagaatttctctcttgttgcccaggctggagtgcaatggtgcaatcttggctcactgcaacctctgcctcccaggttcaagcaattctgcagcctcctgagtagctgggattacaggtgcctgccaccacacccggctttttttttttttttttttttttggatttttagtggagacagagtttcaccatgttggccaggctggtcttgaactcctgacctcaggtgatccacgtgcctcagcctcccaaagtgctgggattacaggcatgagccacagtgcccagccacatgggacagacttttaaaccaattattgcaattcttgcaaaaaagacttaaattgaagttttgttttgttttacaaaaggtcagatgaagatgtcccaaacatatacaggatattaatatatgtttgacacacatgaacataaataggagttgagttcacatacatgtggaaaacattaggttctgtacctctactgcatagcttcacaaagtcttaggtgtattctattcatctgtgaatcttggagagaaatctattgtaggcaaccttttttgaactatttgtccaaaggagcatatatgctagagctacggtttagggtaaatcctgggataaagggagacagaggaaggagcacccacatacatcagaatagttcgggccatttttaagtgaaagaataaaaaattatatttctacagttagtagctggagaaaggaaatatgagagagagggaaaaggaagaataaagggaaataagagatggaagagcacatttgggaaatggcaaggagtcccagaactggacaaacttgatgtagttggtgaaggggccagagcagattatgaccaccctatctgccctttgaaataagtataatcttatctcttgttgaagaagaaaaccttctgaggtttcaagcagggaagtgatgagattttcttaaacagcttactctgtcagtagctgtgtgcagagtttgcctgaaggcactgatcgcagaatcctagctaatggaacaaacttgggattttacttcaaatattcaccaaatgctagccctttaagcaaccctgtggacattagaaggataaattttcatttagtctgtgccagattcagagaaagcggcaagtgcagaatgcctggggaggcagtgagatgagttgcaaagtggaccttgaactggtcttcgaggaaagagcacttgatttttatgggcagcgatggaaacatcctaatgaagatgtcagcgtaaacaggacgaggatgaggcaatctgtttggaaatactggctctcatcagcaaagggaatcacattataatttaatttggattacatataactttttccttaaaacatccataaaagcataccattcccctgcatgaaactttttaatggatttagaatgaaatctaggcactatctgctgccatgccaagtcctccatgatttggctctgcctggcaccctgaccactcctaccacgttattattctcatttctctacctaccccagggcctttgtcctgcctttccctcagcactagctattgtacttatctgcacgtggttgattccttctcataataaataattcaattaaatacattctgtaagagacttagcctctctattttatgtacttcctattttattcatattaacttcttttgtttctccactgcatttattaaaatctaactaatttatgtgttcacctttttctcatcagcctcttcactagaaaataagttctgtgatagtagaacttgcttgttgtggatctccagcccaatgcttagcataattataaaagctcaatgaatacttatggaaataacacttttaaaaataaatgtaaatagtatatgtttttcttaactcttaagttgcttaaatgtctaaaacgtataagcaaacccacccatgaaacacaagaccatgcaatttagttctagattaattctcaatcagcgatcttctttcttgagatttcctctgcttaagcagtagcatataaaaaatggtattaatctaatgaagactttttttttttttttttttttttgagacggagtctccctctgtcgcccaggctggagtgcagtggcgcgatctcggctcactgcaagctccacctcccggcttcacgccattctcctgcctcagcctctggagtaggtgggactacaggcgcccgccaccacacccggctaatttttttcgtattttttagtagagatgggggtttcaccgtgttagccaggatggtctcgatctcctgacctcatgatccgccctcctcggcctcccaaagtgctgggattacaggtataagccaccatgcccggcctaatgaagactttttaaagttgaagtttccagttcacttagtagtactgagggttaaaggtgttaaatattaatgtttccaacaggattggaacacagcttagggaagtcaagtaaatttgcttatccagtgaggtcgcctgtcttcatgttgcattcactcttctaagaaggatttcatccctttttttttttttttttttttttgcatgagaattgaagcagaagcttgtgctgtattgaaagtatattgaatatgggctccgtttattgatgaagctttcaagcactcaccagttaggaggcatagaggaaagagaatgaatgttcactattatataagttatgggcatggtaggtgacttcacaggagttatcacattttgtcttttgaagttaccagggatcttaaatatgtgatgtatgaaatcgccataacctgagtgacctaatctttggtttggggaaaactgctcctgtcttcattttagtatccttgggaataccagatttggggagctacctagtatgtattcaagaaagctgtccatatttagagtgcgcacgagtgagactgccattcgtggaagagaaagacatagagcttcagggcacagaaagttagtcttttaaaaaagcctcttaagggaatttttttccactatatatgtgaagaaataaggctgatgaaagtaaaagtaatatgcccaactgataaatagtaaagatgaataataatccagatcaaaatgtctctaaagcttgaactattcccataatccttccctaggagcataatataaaatggtgtgttttctccaaatatgatgatatcctactttgtgctgggctccaagcacactgggccagggccataactacactcaactaggccctcagctgtagaaggtatatcatgggtaggctggccagatttagtcaataaaaatgcaggacacccacataaatttaaatttcagagatgtaacaaatacttttttaggctagatatgttttgtgtattgcatgaggtgtatctataaacatcgtatttgttgtttacttgtaaagccatttttgagtattttatctggcaacccctgctgtagggccatgagcacagtaaggagtggctccccagtgacccacttctatctcacactccagttcccaggaaggctgaattagagttaatatgagcagtgcaggaagataagcagaattaatgaggaaacttagcaaaaggggttggaataagagtgtgctttgtgtcccaagggacagctctgcttgttacacgatgagaattatgcacaaaatactaaactgttcccaaattacctcagcaactatggttgtttaacaaggcaaacacaacctgcaagctcattggttctgggcaggatggatcctgctgtcagagcaactgatgaactattttaaagccaagttcctattgtgagtgaaatagattaacacttcagatatggatgcttcaaaaaacaaatagcagcatgctaacttagttaatgagtttttgaggaagaaagtagcatttaacttaccaaaagatgcagttcaaggctatattaatgaagtaataacagctgtgtctttatctgttcactacccattcattttctcattacattcagactgctaacttcagtcacaaacatgcttgtatgagaatatggggccttttgttcctaccagaaaataatcaagatgtctatcttctagagttgtactgtatcatagaagtgattcaatgattctgcttttctatttctgtgagaaaaaggcatgctatgggattcaagcactgtaataaacacacacacacactgaagccaggtggacatttatcaaattttgacttcatctcctatatgctgtgagacatgggctatctgcctagctatatatctatgtatttatgtatgtgtgtatgtatctatctatatcaatgtccaccgctgatggttcattaatataaagattgatgatgtaacaccccacatatgcatttcttgacatacaggcattcaaactatgtttttcctttcttcatttcctaatgtgctacactgtgttttcctggtttactgagtatgcctgtgtgtccagaaaccctcaaggacagagctgtgtgctttaggagtcttcctcgtttttgcccctggaacagtgccaaatactatagaattttagttgcatcttgccacaccacctggctaacctcatctcatctactcatgcctttctcaaccattcagaagcacgttctcttcttttaacacgccgtgattgtccatgcccgtcttttctgcatgtgatttctatgtgccatgacacttaagacttaccaccctttcctaatacatcgttcatgcagatctgcattcttagtgtataaggcgcttatgtgttctactgtaactttgctagattatggtgtcaccatggtttatgtctgtcttaccccaaaatattgtgaaagacacaaacgacattatctcattccagtctcagctggaatttcaaatcccattgtctaaatcaaatccaggtgaagatgaggctcttcacatgtagttccttaagctttggcaacatgagtagagttttcttgacggtagatgtgttaactaaagagacaattatctgtcccacatacacctaacatgcaatggcagacaagcaaacaacattatagacatttctgctcaaaaaggatggtggagggaatggaaggcactgtccagtggaagaatcgctggtccatagcaataatgtcaccaaataaggcaaatgttgtaagttccttgtttaggtctcaaaagtgatatcacaccacttttgccatatcttatttgtcaggagttagtgggtcaatctcacattataaggagatggggtccttgagggcatcttagagattgtctaccacacagtttcccagagcctttggctagtttgtgtaggacttccatatgccacaaaggcctgtgtcacacattcttttgtgttatcttctcaatactgcctgtttaaggtgggtaacagttactaccaacaactaggaccccaggaaaagctcaggtttaaatacctgacaaaccaatgattacattagctgccagtggatacctctgtgtgggtgattaagactattattcacctgtaaaatattcatacctctctcacaggaatgtggttagcataaaacaaaataatctatttggaagaaaacaagcataccctttctctaaaaatatttacttttataagtttatgatgctctcaatgtgtagaagacatcgtttcaaatgtagttacataatatgttgatgtatgcggaatgtgctatataagaaggcatgcctttttttcttggaaaattatattgtcataaaaagtcatgtttttgttattaaaatcaaacactatgtatttacaggtctttttttgcaacaattgcccaatcaaattcttatttctgtgaataaatgatatattattattaattatacatttagaagaagcctcggagatcagcaagttgaacctgtcccttttagctgatcagtctgtatatagagttgaaatctgtctgtctgtatagcacaatgtcatgaagtcatagattcctggaatttaatctttgctcttttaattactagaatttgggtacattaattttcctgagtctcagtattcttgtctgtaagacagggctaataatagtacagtgtatattctaacaactcttgtaattgttgaaaagaatttccctagtcaacttatatttgttctctaatctgctccttcacctcatagtctctctagtccttcaagataattatcttggcttctctctaagtcttatctccttagtcatacttattatgatattattttcaactctttcttttcctgtgcactattttcagaaaagcttcggtttgtcattaactcttcagaagttaaaacctatgtcccatggtattttgaaacttagttgagagaatgcatgtcatacttccagagtagctcatatgcagtaaatgatccaaagtatcctgattcatcttttctgtcattttttttcacaccagagttgtgtctctctccaggagatagctttgtaaatattttgctatagtttttttttttttcctcttccccagccacactttacagagtggagatgatactatgcaattctgtctatttaaaatgtatttatattaagttttcttggtatggaaatattgcttatatttatcttgtaatttgttttggctttatagttgtataagagatataagcaaaatgggtctacactttgttttacctgtctaccattaaaaatttcccttggggggaaaaaaaagatgtttgtcttacataactgcagttgttttatatagcctttagtcaacaaaaatatcactcttagtggactaggctagaactgtcttttagcaacttctacttatatatttatgatgatttacttaattgagatataacactttacatattgttctaactttcgtcatctttgttttttctgttccacagataaaaaatacagatatttttgcatattgaggaaataaagtttaaaaatttgacattccttgagccaaaagaaatgtggaaaatatttttcacctttctgttttgcctgattaatgtttaaattctcatcaaaactaaagtaatttttaaaatgccattgttggtaagatctcacagtttggcaatgcccacagttatgacaaacacagaaaactggtatttctgtaaaattgacgctatactattaaaacaatgtgacattatcccctgtccttctttaaccagtagcatacttgtgttttctacttctaactgatcattattttcccatcatatatttaccaaattttacctagagttgtagaaccaaatggttcttactcttcatactgcaaagacatgaatgatgtttggtaaccaaagaaaaatatatgttgcactaaggattagtgttcttgctgttgccactggtctgaccaatgaaaagatggtaatgtgtatattaaagttcttttctctcatatatacaaaaaatattgattctgtcttataacaactggaacttttccagtcattctgtccttcagatatacacactgacaagtgaggacatactgagatgggcgtggatgtcccttatttattgtttgctgtagaaatggaatcacaatctcagaactacagttccagatttcaaaaccttctttttttggcttgatgttataataggaaaatatcttcaatttggtaaagtcaatcttctatccaagaagaataatcttctgcccgtaactacaacttttctaaatactctttcttttttggaaaatgtatggttatgtatatattttactacagagaacacaatgagttttctaacacaattgtgacaatagaaggcaaaagcatgatgctcctgtagctgaaacaggagcattatctttgggaaagctggagttttctctgaagactacagtgtgcctgctgggtcacagtgattccatggtccggggagattgccttattatgcccaacatcttaggaggctgacatttctgtcaagttgccattgtggaaacagcaataggatatgaatactattatttattaactataacaagttgcaatttctgccagtttataaagctacttgagtttgtaaagcttctggttatgtaaaagtgagactgaagtaattaagaccaaatataaattttgtcctatgtcaatacagatcttcaaaaaaataaaatacaaaatatacattgtaagccaactgcaatgtaatcactgtggctttcagggtttgaggtattgaagaattgtaggccatctttgggggaaagtttaccggatatcatttggaaatgaatccccttttgagacggggtttcaccgtgttgcccagtctggttgcgaactcctgagctcaggcaatccgcctgcctcatcctcccaaagtgctgggattacaggcgtgagccaccgcgcctggcctatttttttttttgtattattatttttttagacggagtctcactctattgcccaggctggagtgcaagggtccgatctcggctcactgcaatctccgcctcccgggcccaagggattatcctgccttagcctcccgagtagctgggactacatgcatgcgccaccacccccagctaatttttttagtagagacagagttttgccacgttggccaggctggtctcgaggtcctgacctctggtgatccacccacctcagcctccctaagtgttgggatttccggcgtgagccacagggcccggccttatcaaagatttttcacgaaataaagataatttcatttccttggtttcaacagtgtttcatggaagagtgtattattttcttctcctattatgtgtcttcttttcatatgccctcaatttcccttactcatttatcttttacaaaggcacttcctttctttatttggagctcaaccctcactagcagtacctcgcatatacatgagtttgaatgttcccttacaggaagaggaatgtatttttggcaattctgagcctttttataaagttcagattggatcgatacgttttgcagctttttttgactaaatgaaaactactttaaatgcattattttacctatccgactgactttgtgaattaatggaataatacgagcaatacacttgggctttggagcttagtattgtcagtgctatcgatttgtttagaatatttccatgaatagtttataggatcctagcacactgtggctgaacggaccttttgagacctttcagtctgtaatccagattcttatacttactgagaactgaggctgagatgctacaagacatgcctacattttctcaagtaaagacaaagttaggtttcaacagcaagcatttcttagctatctgctactaggcatagtcttatcatttcacctttactgcttttgtctttaaatgacaaccagttcagatcctcaattcttatagcccaatgtatttatacctagatagaaagatagatagttgtagtccttcttcaatgaggattccatacaattagccttgaggcttaatgacacccttgtaaaatcgttctaattagcaaagatgcattatcacagaagcagttcttacccttcggaaatgtctcgggaaatgtctcacgcagtcattattttgatctggctaaagatgcagtgtagcaagagtggctaggttctactcctagacgctgtcatggccttgttattttcaaagggtgtttgtaagctcctactaccgtgctgcattcatctgtgtgtccctcatgcccagctcagagattaggatagagcaagctcttaaatgttgctggacaattggattttcataagtcacttttaatgattttacatacccaagcatcagctccgattacgctgaaagtgtgatgctcctcttacctagatgacatttaaactcccttcatattgaaaaacagaattatctaaacaaaaaatatggttgaaagagtttatggcaaatagaatttggctgtgaattatgttttccaatccctgctgtatagagcaaattgttagaatcagcatttataattgagtttcaactaaatgctttgttttataatttgctgtgaggtaattagaaaaatgtgcatgaaagcatgacacgtataaatcacaggtatattcatctgaagtattttgtgcagtttatatttatagctcattctgtgaagctaaatccactgtattgaaacagacaattaaaggaaggtaaagggactattttcccagcaattgcaatgtgctaggcatgatgccaggcactgcacaagctctatctccattaatcttctctaatgtaaatattgccaccacttcacaaataaagaaactgaactatgtataaaactgagcttaaggggattaatgaatatattatttgttgttgaacatatgcaggtctaattaaagtaattgcaagttatattaaaagaatttgtggtagagacagaagttgaacccagtgctgactggcactctagttattgttataaaggcaatttgtattattgagttactttgaataatacacattttacatttatttaaataaccatttaatttgtaatgataagtttacagattttttaaaaatagaaacatattatggcatcattgtgtatcaaacaagggctatttataagagctcccttggtgtgcttttattttccttgtctaaatggagccagatgactagaaattgtggaaaagcatagactggttcaataaaatcgaacctggagacaaatccaattctatactctaacacagccatttgtaaagtgtgttccctagtgatattaagaggtgttttgtacacacacactcacatagcaaacattaaaaataaataaatggttacatatgtgcatgacagaattccatgatcaaatatgttgagggattcctgggttgaagaaaataaagcatttgttttaaaattgtgtaaatgctcatatccattgacttgaaaatgtgcctcgtgaagctccaagggagaaatggaatttaaaaaatccccagaccttctcatcacaaaaatctcttttacaagaaacaattgttaaatcttggagtgtaagtagatagcatgatacatcttgggaaatgcttattcatttacttattaacaaaagcgtatgagcacttactgtacgccaatcattttataggtattgggaatgcagaatgattaaaactgacaaagatttctgcccttgtggagctaatattctagcaggggagactaaatataaacaagacaaagaagtgaaatatgtatgactgattctgatgattcttaagaaagaaaaaataaaaacaagcagataaaaggctggacagtgtcaggacaaggagttgaatttttaaacagggagccagggaaggcctcactaagaacgtagtattttagtggaaattgaagttaaggaacaagctctgtggatttttaagggaaaactttccaggcataggaaagttgaaattcaagcgcaaggcaactgtgactggagcggaatgagcaaggggaggagttagatgaggtcagaaaggttaccaggacccagatcgggaaggtccttgaaggttatagtaaggaatttggttttgagtgaagtggggagcccttggagggctttgaacacaggaatgacaaaactcggtattagagctgattttttgagaaaagccaggtgtggttgagagggagggtaaaacaatcaggtagaaggctactgtaaggatctagaggagacacgagggtgacctgaacaaagatttcagccctggtgaactccaatcggattctgaatctatactgagagagagtctgctggatttgttgaaagagcggataccgggtttgagagacagcaatcagagatgagccaggatttcgacttcagtaactgaaaagatgttttgaacttcttagaatgaggaagaccttgagagaaggaggtttggagagggaaagttgaatataaggagctaatttttaggcataataatatcaagatgcattttatgtattcaggtgcagaggtggatttggcagatggaatactaaagtaggcggtaaatatcactcagtttacatagatagatcacatggaaattccaaagttagaatggtctagatttaaatagctaattctcatttacagaaacttcaacgtgaaactacaattctataagctaacttgtgcagccctgcttccagaagaaacaaagaaacagaaaaaatcaaaagggaggaaatatcgcctgccccagtcttaagtgattcccattcgttgcctttcctgggcttgaaggtggagttttgagtaaaacagcagcagtggttgctggatgctttctgatggctctacagttgccctgaaggaatctcaataggagtgttccttaagaatcctgctgatgagcagcactccaccctcaccatcttcaactgaaacagccttagaggaatttttgctggtttatagatcttctgttttgacaaagatagctcgtgacatcactctgccaggctgaaggacttctattctgagactggtgacagcaagccaagaaagccaatactctaagtgaatttaatagactctattctcatgctacttgggttgctatgggaaccttattagaaaatacagggactctagatgatctgctaagttttttttttttttttttaagtaatgtaagtggctttatcttcaggaaaaaaaataagttgtttttctaaaattgtgaacatatagagaaaaatataaaaaacctaaatatgttgcttacacatttgttataaaggacaaatccgtgtaaccagacatatcaaggaaaagaacggtgctgattttttaaaagacagtcacttgcccctttctactcacagtacttccgttatctcaaaaccataaccaaaacaaaaaacaacaaatatcttattatggtctttattttcatgcttgtatttagcattgtatcacccgaacaaaactgacttagactgatttattgcatattatatatacatacataatatacattcatcatgtgaatataatttatacattctactgttcatgagcctttggttgtttctagttttaggatattaggaataattctacctttctacattttagtagccatctttgtataaatgtgctcatttctatttagcatcgttggaccataagatatatgtctcttcaaatttaataggtactgccagacacttttgtgttgtggttttgttgttttgtcctttggttttccaacattgttaaaccgatttacatttcaacttgaattgcgtaagacgttctgttactccacattcttttctgcaccttaaatggtccctagtttgtatattttgccattctattttgtgtgtagtgatatcttatttgtctcccctaaatgagaatttggacaattttcgtctttatttgacatttggataatctgtttgtgaagtatctgttaggtttcttattttctgatagatttcttattttcttattgatttcttagagtaattacttatataacatacaacttgtagctttacaataagtttgtatttctggtagatcaagtaaaccaacattatactttttctacaagtgtgtcctagttattcttggcaatttgtatttctgtataattttaaaatcaactctagttatttttaaaaagaaagaaaaaaatgaacttgatttttatgaagattatgttaaatctatagatgagtttgaaaagtattgataaatatttacatattaaatattctaatcggtctgcttaaaatacatattctttctgtgcatggacattgtctacctcttctgtttgggtcctctttaatgttttccaatacaaatttatagtttgaaaaataagaatgaaaataaaataaaaaatgaaatattctaatctatgcttgtgatacagatttctttatatcttctttcatttgtttgtatcttctttcatttccctcaacatattttatagatttctgtctagaggtctcacacatccttgttagatttaccctttgacatttagtttttttgatgttattgtagatgatatgaatttttaaatttcattttatgctcattatcgttacagagaaattcagttggtttttatatattgagtttatagctagcaaccttgttactcttacttattacacataataattcatctgaagatatttttggattgtctataaaatcatgtcatctgaacattaagatttttttgttctctcttaaatttaaatattttattttttcttaatgtctctctgtctgggtagaccatcttttacaatattaattaaaagtagtcatagcaggtttaattttcttattcccaatctcagaatgaaagcttttaacaatttaccttgaattatgattttgcttaaggcttagaagctatctgctattgcagtaagaaagtttcccttctatttctagttatcaaaaaaattttaaaaattataaatatatattgttttactcaatctatttgtatcatatgatttatcctttagtttgttattgtaatagtaaaattgattagttttcaagtgttaaaccaattatgcattcctgtaataaattcaacttggttgggatatattataccttttaaatattgctagatataagagttctatttttgaaagattttttaaattcacgtttataattgtaatttgggccttattttaccatgaggaaatagagatgttgagtactagtagacatttttaggcctaaagatgaaaagtcttcagtgtagccaaaaaaaaaggcaagcgagaaatgaaagaggcaagaggaaacaacagacagggcacaagagattcaaagagaaaacacataaaaggatgttagaaataggccaagcatggtggctcacgcctgtaatcccaacactttgggagaccaaggtgggaggatcgcttgaagcccaggagttcaagaccagcctgagaaatatagcaagacactatctctacaaaaaattttaaaaattagccatgagtggtggcacaggcctgtggtactagatactcaggaggctgaggtggaaagattgcttgaacctaggagattgaggctgcagtgacctgtgatcataccactgcatttcagcttggatgatagagtgataacctgtctcaataaataaataaataaataaataaataaataaataaataaaagttaaaaataaatttaaaaaataaatcttcataatcaatggacatatgcacatacataccaggcaaacaataaccagagtaatgtgtattattaatatcacataatataaaattaaggaaagtttattagaaataagtttctctctagttaataaaatgtttacctaactaggaagataaaaaattgtgaaggtatatgtacctcataacaccacctcaaaatatataaaggtaaaaatatgtgtgtgtatattcctgtaactatgaaattgatagaataaaaaacaaacttaaatatttataacataatgggatatcttaggcacctttcatagtgattgatagatcaaataaataatcaaaaatttaaaagattatgtatgatatgaagtgtataattaagcttgatgtgatggtcacataatgaatgttatatctgaagaacagatactgtttccaggaacatatcatttatacaaataacaacattctagtgcataacacagcctccacaaatttcaaagagttgatattttgcacaaaatactaaccacagtggaataaagttaaaaattaataacaaaaaggaagaccagttatgccttttataatcagggatattaacatatttatagttaattcttagaactagaagtaatgataatggaaattaggatatatttagaattaatagaagtgggccaggcgcggtggctcacgcctgtaatcccagcactttgggaagctaaggcgggcagatcacgaggtcaggagatcgagaccaccctggccaacatggtgaaaccccgtctctactaaaactacaaaaatttgctgggtgtgttggcgtgtgcctgtaatcccagttactctcgaggctgaggcaagagaatcatttgaaccagggagtaggaggttgcagtgaactaagatcgtgccactgcactccagcctggcaacagagcgagactttgtcaaaaaaaaaagaataaatagaggtgaaaatacaaatacttcatattgaaatgtctaggatgaagctaatgccatgtttacaggtaaatttatgaacttttcttatattagaaaagacaaatggctcagtgtaataaaccaaaaattccaccaaaaaagttagaaaaaatgaatcatagtaaaccaaaaagacagaagtaactgataaagaatagaaggaaaaaatgaaataaaaattatcagataaagagaggatcagatgagacaaaagttggttattaaaatgttaccctataacaaaacaaaacaaacatcaagctcagttgattttggagatgagttctataaaacgtaccagcaacacaatttcaagttatacaatctctttcagagaattgcaaagaggaaacatcccaaaatttattttaaatgcatggcataaccttaaagacaaaatctgtcaaaaacagtacaagtgaggaaagagcaaattgaacccagcaaagtataaggagataatatcacttgatcattattcctgtaatgtaatatttcttccattttagcaaatgtactaggtgtaaatcaccacattaaataataaaggagaaaaaaatgatcattttgatagtaacaaaaaataattaaataagcctagcatatattttttttagatgaggaaaaactgttaggcaaagttttacacaattccttttaaatcagtggggaccaatagttttaaaagggtaagatttaagctgctctacaaatctacatataaaccaatttgtgtcaacatctcccattttctttgtcatccgtaataccaattttggttctcaggttaatatgtcatttttcctgtttgagatttttctcctgtacttagagtcctttaacttctccactgcctctcacatctttttgtataaatttgtatttttcctattaagactcaattcatctattaccttcactgagaaatattcccgagaacccttaccctgaattggcacaactatcaggctccataagttttgcctctacaataattttttttttaactttaagttctagggtgaatgtgcagaatgtgcaggtttgttaaataggtacacatgtgccatggtggtttgctgcacccatcaacccgtcatctaggttttaagccctgcatgcattaggtgtttgtgctaatgctctccctccccttgcccccactgcccgacaggccctggtgtgtgatgttcccctctctgtgtccatgcgttctttgttcaactcccacttatgagtcagaacatgcagtgtttggttttctgttcttgtgttactttgctgagaatgatggtgtctagcttcatccgtgtgcctgcaaaggacatgaactcattcttttttatggctgcatagtattccacggtgtatatgtgccacattttctttatccagtctatcattgatgggactagttttatgattcatttctatcatggcaatttctatatgatattgctgttaatatgtagatgctattcccactgagctgtgaactactcaaggcagggggtgtgtcactcatttcagacctccagcccttagcactgttccccacatcctgagggcatccaatacacctttgtcaaatgggttgaagagttgagcttagaaatttacattctttgttcctgggaaggctaatcatagagaaggcataaacatgaaacattaaacaagagagtttaatcatattttaagattatctgagaaaaaaatgaaagacaatccagcacaataacattctttttttttttttttttgagacagagtctcgtctcgctctgtcacccaggctggagtgcagtggcacgatctcggctcactgcaagctctgcctcccaggttcacgccattctcctgcctcagcctcccgagcagctgggactgcaggcacctgcctccatgcccagctaattttttgtaattttaatagagacggtgtttcaccgtgttagccaggatggtctcgatctcctcacctcgtgatccgcccgccttggcctcccaaaagtgctgggattacagacgtgagccaccgcgccctaccaataacattttatttctcattttaatgttgtaaaataaagtgagtgacagctggtttgagtcaccagtctgctgtttactggctggcctaatgtcatttccttgttggtaaattatagataattattttactatagcattaggttgttgataggatcgaatgaaatactgcagctaatgtactcaatgcagtggctgagacatggaagtgcctctgtggtctatgagtattatctttccaatcttgagaggtagtagaaggctacaaagtgttggcgtttgagtggtgtttaagaaatggagacaatttgaagagaaagtgatttgggggtttgcaagtacagtttacatgatgaaaggtaagaaaagaatgaggctgacatttattgagcctcttcaacatgtgagttgtttgaccaggcatcttcctgacatcctaccagttaatgctcacaaccagcacctgatgaggtcctaccacaccatttactcatgaaaaactgctctctggaagttatgaagcacatgctgaagatcacacttggtggaaccaggctccaagcctgtctgattttatagctactgaacttcttctggagatggctagaaaaggaggaatcaaggatctgtagaatctttcctgtgcctggcaaagaaggatgaggctgactgtgaatgaatttgtggatatagataaatagctattttccatgaaatacctgtttattgttgtaggacatctaaaagcagattttaatgagaagaatgatgttttgattttctacatgaaaataaatgtgaacattgatatatgtaaaatatgtaagtgaaaacctttgctttttgaaaaattaaagtcagtacctcaaatgtggcttataagtcagcaaaacaacctgaaactagatttaatatcatgtttattcaacaaattatatggttagtaatcagtatgaaaggttgtttcttcccagtggactgtagcagaaactaacctcattacatttgagaaaccatcattgctagggactagttgaaatgtctgtctcagaatggcaaatggaattgcattttaaagaaacttagagtctttattgttttcatcactaaaccccatactcatgattagcaggagtcatttgtcagctgaaatcatactggttcttccattttagtttgatccatttccatccatctgctcatgagagaagaaattcggtttggtgaaggatgtctggaaaatgcgaagaccaccaacttgggaaacttttatcatcacgatacactgtgtatgtctctgaacaacaacatggtttgaatgaagcaaaatagagacttaaaatgtaactaaatgtacaattgtatgaatgtgtaagtgctatggaagaagaagcctttagaagttctcaatatttactgcagaatttcaaaatagtcttggattaaacaccttttgagaaaaaaatagacgttcctaaaccataatctaatgcttgagagaacagaataattttcagtacaagtaagtttaaatgctaaatgagatgagatggttaaatgtccagatgaaaggtaaaatacattgttccatcactgaattcacagtaacatgcaaaagatccatcttgaatataacctgcccagtccctgaaacaaacccaaggcttctttttttttctgatcttgatttcttgaatgcatagtgcttttaaagaactaacatgtcttttttgttttgttttgttttgcgatgcagtctctttctgtcacccaggctgaagtgcagtggtgggattttggctcactgcaacctctgcctcccgggttcaagtgattctcctgcctcagcctcccgagtagctgggattatagatgtgcgccacaatgcccagctaattgttgtattttttagtagagacagggtttcaccatgttggccagactggtctcgaactccagacctcaggtgatccacccgcctcagcctcccaaagtgccgggattacaggcataagccactgcgccctgctagaactagcatgtcttaatgtgttaggtaataatagaaatgtttcattctctaattaaatgatgaggtgattaatagtaggttaaagatactgtaattatatattgagtaggatactattaatatatgttcacttagcacttactataaggaggaagacataatgtagccttacagcccagcaactagggacccttccaacttcaggtcctcaatcttgtgcagcagacctgcagagtctccttaaagggaggccagatgtgccagagagtcagtgcccctagagcaaccctcaaccaatgagagatagcagttgataggtaagttccacagcctcttgctccacattgggacaaccctgagtctgtccacactggggctgagccctggttgcctacagtggtcagccacttattaatccatcctttattggtctctcccttttttaactcccaaaccccctcacagtgttccttgggatcaattcctaaatccttctctcagagtccaactaaaacgtggaggcaaatatgtaccaaatagagctcatgttctcccttcaagaccacccttcaggtgtcaggagcctcacctggaggctccctacccagatggtcttaaggtgctcacagggccagctcagatcaccctttccatgggttctgactacacaaaagtagatggtgtgccacagtccatacccctaggcccaaaatttggaatgaccttggacatccagattgattgcatacacatttgcatgatgctcttgtcaagaggaaatcagagtgagaagggaaagggagcaggttctgggcctgggcctccatttgcattcttgccttggaattctgagacattaggtgtggggctgaatagaaggccaggagttttaccttttttttttttttttttttttttgagacagagtctcgctctgtctcccaggctggagtgcagttgtgcgatcttggctcactgcagcctctgcctctcgggttcacgccatttttctgcctcagcctccctagtagttgggactgcaggcaccccggctaatttttttgtatttttagtagagacaaagtttcaccatgttagccagagggtctcaatctcctgacctcgtgatctgcctgcctcggcctcccaaagtgctgggattacaggcttgagccaccgcatctggccaggagtttttatttcattggttacacgcagtgaattattggcaggtgaccaaattgttttggtctttaacgacttcatgtgtataatgagggatgtatctaaatttattcatagggtccctacaagaccataggttctcattgtcaaagtcatagatagccattcttctgcacataagggacactaaaaagtacccccttattttctggctgggatctctgaatgctcacactgtatgatttggtggggctctcatgccatctgttctaggcctctatttactcttggtttaaagaacctagagtccaaaggtgcatgaataatgcaagtcatattttagataaaataatacagataacaactgtacttaacagtatgaacaaaatcatgcaaacaaaaccaaaattgatatctgaccagggagaaaggacttaggaaatatatcagtacataaatagtgaatttttatttggatgtgttgcaggaatgtgcgtagtatttttttctctgtgttttaactttttcctacctgtgcatttcttagaatcagtagctttgtcagcatgcactcagagaaaccatggaagcatatttagtaataaaattgttattcttatagacaaatataatcgtttaggaactagcatggcccttttattctcaaaactagcctcagtcattgacgatgattgctatttaaaggtgtagagggaaatatttggggaattgtctgcgtatttcaaagtacccttaaaaatttaaatcagacaaactggataaattagacatcctcaagtactaataggcaggtctgctctaagaatagtagaaggtagaagaaattaatggttacgagaggggtagaggaaattaaagttaataactaaagatattgcactagtttgtttttgcattgctataaagaaacacctgagacttcgtaatttataaagaaaagaggtttaattagctcaccgttctgcaggctgaacaggaaatgtagtgacatctgcttctggggaggccccaagaagcttctaattatggcagaaggcaaaggggcagcaggcatctcatatgatgggagcaggagcaagagagagtggtgtcacacttttaaaagagatctcatgagaagtcacacagtatagcgaggacatcactgagggaatggtgctaaacaattcatgagggatcccctgccatggtccaatcacctcccaccaagccccaccttcaaaattggggattacatttcaacatgagatttgggtggggacacgcatccaatctggattgcatatcctcatcaaaatgtcaatacttttattttgatagtgttactatcattaactatgtacagtactttattgttaacaatttttttctccagcataatactgtttagtatgacattactgtaaattattataaatgtcttaaagattattaatttcagaatgtatgatgtattgcctttaaaaatgaacatggactttttaaactaatataggtataggaagaaataaaatctcattccttgacaaatactaataaaacttattattgagaataaaataaacagtacttatattatgtcagatattctgctaagtcttttgcatgcgttatttcattttttaaaatcacagtggccttatagggttggtataatgatccccattttacaaatgaagaaaatgagacccagacacactatacaatttccccagattcagtcagaaaataaatggtagagctgaaaatgtactcacatcctaaaggctaaagcctttattatgataaaactctgtgagatgacacacattttgatgactgcattagtttaaaggaaatttttttcatggattttgccttcgttttgctttgttttgctagtgaaattggtcctgctaagcagtataacacaaaatgagacctcagatctaaaattcagagagctctaaaatcaccaaactaatctaataaaagaaaatacagattttaccgaaatttaataggagttagttaatataaatgtttgaaataataaacatccccagaactatctaacagcatgtgttataatgtccgtttgaactgattttaaatgaatagaatgtttttcattccctcctgtactgagagcgcttgcctttgagtgttttaatatgtcagggatcatttatattctcaaaaatatattacatttatttggtttcattctttatctttcaaccgtgttttaaatatttacaatttcagcaaatttgaattttttttgtctttaaaatgcctctccaaaggttttgaaatctctatgtgtttgtgtgtgtgtatgtatggcttttattggccactgatccaagtcgctccaaccttagagaggtggaaaaatggtgagaatatggattatgaagggacaaaaggatggaagccaaaaaaaatacaattcataaaaggtcctggaatctttcctacacaaatgcccagaggcctcctcattctcaggtactgctctctgcaggatgaacctttcacctccactcccatccagctctaggagtgatcctccagaagaataatgggacttttagtgattccctgtagccaatagccaagcggcagcagaatggtacatacagaacaggtgaagatttcttaagcaccagcagtgattagaacacagtgggataaggtcaaacagagcagcagatggctaaaattatatgtgaaagtcgttttataattgtgaagaacttggtggtggtgcacaaatccacattctgtgttattcaggtacctaacatcaatcctcctggtttggaagacttcagatttcacagtttagtaatcaccatgctttagcaatggtacttgcttttatttagcggcactgtaataaagattactcttaatttaaagtataccccttatatagtagctttttcgtttcattttaggttttaatatatttgttactgtagctaaatacataaatggataggtaaatatatagctagatggatataaccaaccgaaagatacatgagaccatttttagtaacattattctattattgcatatatttcatatactatgtacatcatggacaaccttgatgatgagactcaggcaatctgattaaatattgggtttattcacagtttgtaaatattgggtttattcaaagtttgtgaactcaggaggacacagactccaaaaggaaagggtcagtgctccaaagagggaatgtttgaagatcatttaagcaggaaagttctggggaagattaaaaagattacattatttttccatagagggttagtgaatagttacaacaatttgcttagttatatgcagcatttctttttttttgaaaggcatatttaacattctatattaaagaaagacgtaatagtcaaggggtcttttgtctcagtcaaggggtctttttttatgtcagggccacgtggtcttagccataaaaaaggaaattcggaaggaagttaatctatttttgaaaggtcagtaattaaaagttcaagctgtgtgactcagtttccaaagtcaacaatcttcagggcctaataacttttagaaactccaaatagacacactatccatttgctttcacatcatcaattatgtatttaaaaagaactttgtttctgtatacattattatatgtattatatatgtgtatatacatatctgtatacacatgtatagttgacccttgaacaacatgggtttgaactgtctcggtccatttacatgcagttttttacaataaatgtattggaaaattttttggagatctttgagtttttgggtttgaactgcattgatccatttatatgcaattttttataatatattggaaaatattttttggagatctatgagtctttaaaaattcacaggtgaactgtgtagcctagaaatatcaaaaaattaaggaaaagttaggcatgtcatgaatacataaaatctgtgtagatactagcctatttcatcattaactaccataaaatatgcacaaatttactataaaaagttaaaagttgttaaaacttacacaaacacagaccataggtggcatcatttgcagtcaagagacacataaacaaatgtaaagatgtagtattatgtcttcactgcataccattcactatagcacatactgtaaaactgtaataagtttgtagttgcttcttgttgctatcgtggtgagcccaaatgttgagcgtgtttgcttaaaatacgtgtgatactaatcatctccatgtaagcattttgcctctccagtaaattgtatatccagtaaaaagtgatctctctctcttgctgttcttatatatttttcattgtgtttagtgcagtaccttaaaccttgcataacaccatgggacccatacaaagttctgctagtgatgctggaagtgctcccaagaagcagagaaaagtcctgacattataagaaaaagttaaattgcttgatatataccgtggattgaggcctgcagctgcgggtgcctgccatttcagacacaattcatcttgtaaacagatgacataaacttatggtattgataaataaagcacagtacttcaaatgtattttctcttccttatgacttccttaagaacatttgcttttctctagcttatcttattgtaataatacaatatctgatacatataccaaatatgtgttaatctactatttatgttatcttaaggcttctggtcaacattaggctattagtaattaaatttgatgggagttaaaagttatacctgaattttcaactgtacaggggtcagattccctataacttccacattgtccaaggctcgactgtacattacatatatatatatatgttataaagaccagcaagatttcagacacaagcagtgaagtctggacttacagatgtgttgactctggttactgtacatgtcttgtcatccctttggcattcaatcgtgtcactttacattatcagcttgtattttaacatcttctttttttcaacaaatatgcagaatagattttctaaaagttcagacatggtacaagacaagcttgtccaacccatgtcccacaggccacatgtggcccaggacagctttgaatgcagcccaacacaaattcataaactttcttaaaacatcatgagtctttttgtgattttttttagctcaacagctattgttagttttagtgtattttatgtgtattgcaagacaactctttttcttcaaatgtggcccagggaagccaaaagactggacacccctggtgtaagagatggtggcatggtaatcacagtgcctctttaatgtgtcatggatactcattaatcattcaacaacagaaaatggttggtctcctttgccctccttaaaatgagacatggaggatgagcagcatttaaaccggaagaaagggagcttggtggggaagatatttcaagcaaaatgcatcaaagtgaagttctagaggtagctaagtatggtttatgcacatctttgttgaaacagtattcctcaatgttttttatatcatgggaaacagaaactatggtttgtgagatttgaaggaatacatagaagcatatcttaggcatatgaatgggatatgcctatatcaaagaacagtaatgttctttgctagacctctgtgttagagaatcatatacatgaacaaaaatattaggaaatcaaaaaaagtagatggggaaatgatttcagagggtttcaatggtgataatgatgtcaacaaaaatagcatcgactatttttccctgaggagcccaaagtatttctgatacatacttccagtcatagatggaactgattgagcacaagcttaattctaacagaaacaaaatgtgagaacttgaactttaaaagaacattttctatcctgtagaaagcatgatctaaatttatagtatgcctgacaagtgtggatttttcacaattccctgaaatacagaaaatgaatttaattaattgtgctccaaggctgagttcatactttggcttgaattcattagcaagtagcattttaaaaaggaagtttggttgtgggtgtctgtccaatttggaaatatttacccatggtctttatatttaaaatgtgtttttgattttcaaattctgcagattatttatatccatatgcctgttcagtttggtgtattcataacatggttcacactggccttgtattttctcagttcactgtatttatcagtttctctccgattgtcttaatccatccagtcctccattccatttcctaggcattttctccaaagccttaatttctttgtcttcttcttctgtgttgacagtgattattgaaagctttttcttcattccaccaggttacctgttcagaaattgggcttctaaaataaggcatttagcaccaaaatctctattatttgaatggttattccatgttttcactgttttgttgtttcattgttttttgtttattttgttacatgtttttactgaattattatttttatgaagttcttcgatagtgcaaaaatcttggggaaagtgtgcttccttttctttaaatacactgtctttcagaattggcttttactttccttgctttctgaacctttattttccttcattcctgctaacccccgacctcccatttctttcttcctttctctctagaatttaaatagttatcaagttgcttcttttcatttgctcatatttatttaaagggcagctttgtctgaaacttctactcatctggatgcactgagggattgctctctttgaccctatccaagatattaacaatgtttctgtcttttccctgggcttcatgtggatgctaattttgcttctaaccacattcctgtatcctgagggcaatgggataggttagaggctagcttagctgtggccatgtcatatgtcaatctagcaagactagattatctttaccaaaatcttatcaaaaatatcaaacatggccttctgcacccagctacgtgctatcctgctcatacagcttcacccaatttctaaaactcagcatactgctctagaactttctgactccactgagctcccatagcagtatgttggggcttctcttcttaaaactattccctcaagtagtctcctcagctctaaaaattgagtgggaaaaccagcaagaatcttcagggctttattcccttctgctcctcaatattaaccctgtggagaagacatggggtttgaggcttcacacgtcgtatcataatttatactacttttcatgacagcaatgttaaaataccttgtggcataagatcacactctagtccttttttagttgctgctgttgaactttgggcttttattaaaacattaatttctataggtgttggggaataagatttgtaacctggctttacttaatcatctttatccaaaaaatattttaaaacagcaacagtttgacataaatgtagcctcagaattttcaatattagaagaataaataagttataaattttgcctatttctatattgccagatagaattttaagaccacaagacatcatgaaatttaaattaaaacatgtccagtaggaaaaaaggttttgtcacttaggtaacatgactaacatcctaatatgctttctcgcatttttttaacataaggcaatccattgagcaaatcacaccaacatttttttttcatcattcttaaatgtctctcttctagaaagggtgaagcatataaaatcaccttgttattaaaggagttaagaaagaagtctgcagaaatcagtttggaggaatattgaatctagtgttttgttttttcatagaaactttagaaggcatgatggtgattatacacataaggaaataaagaatggctgtattaggtcttaattagtgattataacagtggcaaaataacagaagttgaatgggtccttacatctcacttcagagaaaagtgtaaactgcagtcaatacaaactgatttgggttagcagtcctattattctcagttgcccagagaatgaagaaaatgttctttatcccatcgctaagagcagctacagtgaggcatcctctcttggggcgctgtctacccttcatgcctctagagattcttggactctttgctgtcttcactgagttttagttcactgggggataaattcttataatttctttccaggtttaaaataatacctgcctatatttatttgacattatacagaaaaattttggaagatcttcttatgtaaaatttatattctgtggagttgaagctatattatgattttataattttctggaatatatcattttaccccacttttaacagtttgcgaatcatggattctattgtagtctcctcctttctcaagtcagttcacatcttgacaaattttttattaatcaggattatacaatgttgatccagtctgtctggaggctattaagaagcattaatggaataaaagggatattaatttatcatcaattatttaaatggactgtttcttaaaccagtctgtgttttaatataacttgggcctatggaaccttcgtagttgctattaaataagaaatatatgtgatgtatgttatacaacatataaggtatatattatctatacacttttcatttatttcaatacagaaggttttccatttaattccacaggtattttttaagcactaactgtatgcataggtactgtatataaatacaatgtaagtagaagctgcagcccatgttttgaggatgtgaagtctacatgtgtagagcaaatgtgtgaaaattatgaaaccatttaaatatatattgatcaaagcatgtaggcaatgttttgcctgtcttgaaagcttagaaccttagcctgacttatgaaacttactagatatttacccgtgggataaaccatcattcctccttgagcctgattaagctctctttatgaagacattatggataaagtgtcaaaatggtgcctggtttggagtagcttctcaatagccattacttttctgcaagcctgatgaagcatctcacatcacaagagactttcagatgtctgtgtattgtggtggaaaaccaactcccattcctttgcaaggccagaagcaaaagctgccatgaggaggtggtcttaacatggcctggcacatgtaagctgttaactcactaggaaggaacaagtttgcaactggtgcaggagaatgtctcagtgatgagcaagacttctgcagtgagtccacaagtatgtctttatgcctggaattcattatcaaggaattcagaaatgttttctgagaagaaatccacctcggtaccctgcatatttcagtacaccttgacctgagcagaagatacactgagacctgccaagttctgagcatgaaaagctttaattcattgtgttaaatggcaaaaccaagcaactggtgatttatggctgcaaattatcatgttgttcattagtggtaattactactcaaccctgaaataaaacggcaatcagtatgctaaaatgagaacacccacgctaactccttgctgttcacctgcaatcctctctgtctgtctcactttccaagggaagagaaaaaagactgagggaatccaggtgcatgtactatggacagagatgagcttctggccatactaaactgcttcagtggctcctgtcaggcaaaggagcttagctccatccctagatgctctctgttcacaatgagataagagatttgtgtttggacatactctgggaatgctcagattgctttcagcgactggagctgtggcagtcaggagggagaggaagccaatggaggtagtgtagtgagtagacaccacgccctcagcgactggagctgtggcagtcaggagggagaggcagccaatggaggtagtgtggtgagtagacaccacgccccagatgactgtagctcccgtggaccccattagcactgtcctccagtagtctcttcaggctatatgcctggctgaccatcaggaaactgaggccatgccttgcgtagaaagacttaatttcacttttgaacagatggccagaaaccatgcaatttcacctgctgtatctgttaatgtcacactaaacagctatgaagtaaaaactcccatgcaaacaggttttcattttatttctgtcacaattattacctcctagagatgaccttcaatgcagagaaatggatttttgactttaacataatgaatcttatgagcagttcacacaggcattctgaagaacaatacaggttgaacatccctaatctgaaaattcaaactccaaaatgctccaaaatctaagattcttgatcattgacatgatgctacaactggaaacttttacacccgacctcatgtgacaggttgcagtcaaaacacaagcacacctctcatagtttattcagtgaccccaaggggaaaaaaaaagaccctccaagtaccattcacttgtgataggtattttctgtgcacacctagatactcccacacaagtatgcccacaatggtaataaaatgacacatgtgcagaccagaagcaccagcagtaggttcctaatgatgttccacatgaggccaagacctacgttcattactcactgaagtttttggcttatgctatgctctgtgatatcaaggatgtgatgatatttgttgaaaatgtcaaaaaagcctgtagatacctctatgagtaacagtgataagaacaagaagaaggatttatgttaatttagaacacagaaagtcaagctgttggagaaactgaacagcagtgtaagtgtgaaccatcttacagaagtgtatgatggtagaatggctaccatatatgacttgaagaaacagaaggataaactgttgaaattctatgctgaaagtgataaacagaagttaatgaaaaatagaaaaacactctaaagcgaaaactgaaggtcttgattgcatattgaaagagtggatccagtagtgtcatggtaaacatatgacaatcatattctggccatgaaacaagaaaataccaattacaatgagctgaaaaattatagagaactgtgaagattcaacacgctggctgcagaaaatttttaaaagacaaatttgtaaagacttgtgataaatcatctgcttatcatgaagcagaagagaaattcattgacaagtttgccaatgtcatcactgctgaaagtctgacaccagaataagtctataatgctgatgtaacataacgattttggtgttattgccccagaaagaaactgactacagctaatgaacagctactagaggaattaagaatgccaaggacagaataactgcaccaggatgtgctaatgcagcaggcacgcttaagtgtaaacttgctgtgttaggcataagcttgagtcctcaatgttttcaaaaggctaagttcttacttgtctattattatgctagcaggaaggcatgaatcaccagagacatcttctctatctggttttacaaacatttgtaccagtggcttatgctcactgcaaagaagctgaactggatgaggactagaagatttttttattccttaacaaccgttctgttcatcctccagctgaaattctaaaaaataatgtttatgtcatgtactttcccccaaatatgacttcattaatttggccatgtgaccagggtatccttagatcaatgatgagtaaatataaaaacactttattgagcagaatgctaacagcagtgaacagtagtctgggtatggaagggtttcaaaaggagtttagcataaagaatgctgtatatgctgttgccaacacttggaacatagtaactgaagacacagttgtgcgtgcatggcacaacatctggcctatggctatgttcagtgactatgtttcaacccttcttgcacagatggactgactttaaaatattgattaatggcagcagaattaaatccctttacaaaaatcattgtcattctttaaatagggtagagggtttaccttctgaattttccatttagcatgggtcagaggtaaatatatatgtatgcacgatctttgcagtgagagaaatcaaagaatattaagatctctttatgcctgctaattttgagttgtgaatttttgagtacgtctaaagaatgggatatggttaagtggtttataagcattttttttcagtccttgattcatcttttcattatctttaagggcagatatttttaatttaaaaaaatctaaaattttaattttttcattcatgggttgtgcctttggcattatatctaaaagctcaacacgaaaccccaggtaacatagattctttctggaaagttacaagctattaatttaattcttttaataaatgtagtcctattcagattatctacttctggtttttgtagattatgtcttttaaggcattgatcaattttatataatttataaaatttgtgggcatacacttgttcataatatttattatattttaatattgatgagatcagtagcaatgatccttctttcattctttatatagtaatttttgtcttctttcatttttttcttagttaaactggcttttagaggtttaacaattctatttatcttttcaaagaatcagtttttcttttcattagttttctttattgatttcctgttttcaatttcattgatattgctctagtttttattatttctcttcttctgattactgtagatattgatcttccttttctagtttttaaggtagaaacttagattaatatttagatctttcttcttttctaatatattcattaaatattataaatttccctctaagaactgcttttgttgcattgcacaaattttgatgagttgtattttcatttttctttaattcatttttatttcaaatttcttttgcctcatctcctttgattcatgtgtttcttatttatattttaatcccataatgatctgagagaatactttgtatgatttatataattttcatgtgttaagatatgttttgtgacccagaatttggtgaatattttatgtgaaattgagaagaatgtgtattctgctatggttagattaagtcttctataaatgtcaattagatccagttggttgacagtgctattcagtcaactacatccttactgatagcctgcttgctggatagaagggttcaagtctttaactaaaatagtgaattaatctatttccccttgtagttcttctagttttagccttacatattttcatgctgggtttacaggcatcatacattttaaaaattgttatgttttctggaaagttgactcctttatcattatataatgctcctttttatccctgatatttttttcttgcactgacgtcttctgtcttctttacctgaaattaatatagtcacaccatattattttggataagtgttagcatggtatatcttactccaccatttatggcacccacgccattatatttaaagtgagtttcctaaagacaatatatactttcatcttgtttttaaaaatatacttcgacaattgcttttaattggtttaggctatttatatttatagtgatttttgagatttctggattaatacctatcatatttgtaaatgttttttagtaattgatgacctgggtttttgtttctttttctttgccttccattttgttttttcatttttggatctaattaagtattttatatgatggtattttatcttctctgttagcatatcaattatgttttctagatatattttgttagtgattccctacagtgtgctgtacatttacaactaatctatgcctactttcaaataatactgctcttgactagtatagataacttataaaaagtacttccggccgggtgcggtggctcacacctgtaatcccagcactttgggaggccgaggcaggtggatctcaaagtcaggagatcgagaccatcctggctaacacggtgaaaccccgtctctactaaaaatacaaaataattagccgggcgtggtgcaggcacctgtagtcccagctactctggaggctgaggcaggagaatggcttgaacctgggaggcagagcttgcagtgagctgggatcatgccactgcactccagcctgggtgacagagcgagactcaatatttttaaaaaaagaaaaaaagtacttccaattacttattttcatcccttataacattgctgtcattcatttcacttattcataaactataaccacccagttatctgttagttcaaataaaaataagaaaaataaacattttattttacctttatttatttttttctgtacctctctccctttccctaagtaggtctgagtttctgacatataattttccttctttctgaagaaggcttaacattttttgcaaggtatgtgtactggtgacaaatttccttaatgtttgcttatctgagaaggaatttctcctttacttttgtagattaaatttcactggctacagaattctaaattggtgatggtgggttttgtttttccattaacatttgaaatattgactgccttctcttgttttcatagtttctgtgtggaagtctgtaatacttatacttggttctctataggtgaggtgttttcccttcccaccattgcacattcccagtctcttttcaggattttgttttgattttgtgcagatttaacatgatgcataatgtagagtattttccatggttggtattctccagcttcctggatctgtggttttgccttcatcattaattttggaaggttgtcagctattattacttcaaaaccttttctatatggttttctcttgattttccttctcgtcttcctataatgtgtgttatatctttttaaaattgtctcctagtttttcaatgttctgttccactgtgtgtttattatttttctctttgcttttcagtttttagtgttgctattgatacatctttaagcatactgagtccttccttgagaatgttaaatccactgatgatcatcaaaggcattttttacttccatttcagttttttttttctagtacttcctttggattatttcttagaatttttatctctctgcctacattacccatctgttattgcatgttgtgtactttttcattagatcctttggcctaacaatcagttaaattcattttctgatcatttaaaaatctctgctgtatctgagtttgattttgattctccctttgtctcttcagatttaatttttttttctttttctttttagcataccttgtagttttcttgtgaaaagctagacatgacatattaggtaaaagggattgacataagtaagcctttagtgtgagtttttaagtaagtttttttcctgtagctagcagtcagtttttgtttaatgttaactgtagttacaggtgtcagaggctaaaatttccttctgatgcccttgtttttgtcttccctgttgtccttggacttccctagagacttctttctaaataaattctgaaacatgtggttttttgtttctattctcctgttattgtgtaggatccctgtttatgtgtggtaaggtgtgcaggaaagaaagtgttttattattctatgatgagagctcaatcctctagtgggcttgagccccagaggtgggtccttcacaagtgatttttagctttttttttttttccccacacccctccccttacatgagacaagctagagaggtttcaaattaggtatttccctccaatgttgaatgttagaggaagctgtaattgggtatttctcatggtggttaggttctggtacaatagttttctctggggaaaggcctttgttaaggagaacagaacattctgagtatattttaaatgaaaactttttcttttcccctgccagatgcattaggggattttcctcatcttcaccatgataacctctagaggtttatggaaggaaaacttatgaaatcatggggatccttctaaggctggtcctgcagaagtttttatatttcaagcttgtccacacccagtgtccaactgttagtcaagtgatgttgaagtgttttaacttgtttctgactccagcaatggcttctgctccctgtaatctataactgtatttatctttctctgcagtttttaaggtagcagtttgccctgtgacttccattttccaaaggctctaagaagacttgttcattttgtttcactttgttctttttgggaggataacagcaataactgctgagctctttacatgccaaaaaagaaactaggaggtctatgacctgtttttgataatcacatatgactttgtagaaatcaggaacaagctctttgacaataattaaggaaatgtcagtcagataatttcatatttgaaatacagtaaattttttaaaaacaaaatgtgtatctttttaaaataaacaatattcctggcacacagtgatgctatatttgcatattcccttaagaatttaaatattgtgtaatttttctatttgctgtggcaataatacaattgagtgaattcttttgcacttcaaagtaaaaaaaaaattagacacaaaatgttcctagtgagattttggctaatctgatagacccatatgtaaatgtgctgtacaaaagtctgaatattttaaaactgttaatgcatgaagtccattttaggttggttccacaacctaaatgatactcactaaacctaaaaaattcagatgataatttttattataaacattggggaatatatacatgcattttcagtttctctcatatttcaatttctgtgatcttataaattcaacaaacgtttatttttctgaaataaagacatttatactcaataaaatactgtaatattacagatctcctgaataaggctctttctagtgctagatctcagtagccttttttatttgttcagagaatggaggaaggcaaaaaaatccaaaaaatatatcatgttctatttgtataaggctttacattggataaaagaacactattgatatctgaatagaactgttatgacttatttgttgttcttgtcattgttttacttctttaaggttggggcaatgcctgagcacactggtttacacctgtgatttcagcactttgggaggccaagttaggaggattgcttgagcccagaagttcaagaccagcctggacaacacagcaaggccccatctctacaaaaataaaataaattagcttggcatgatgtcacatgcctatggtaccagctactgaaaaggctgaggtgggagtaatgcttgagcctgggaggtcaaggttgtagtgagccatactttcattactgtacttcagcccgggtgacagagcaagaccttgtctcaaaaagtaaaaaaggtgggggaacaaaaataaaaatttctgtacagcaatgtagcaaagttccagtataccttatataatgttagtcacctttgtgtgagattctcctctattcagagatgtgagtaaatagatgcatattaagtacaattgtacagtataaagatcccagcaattacattttttttttttttgagacagagccttgcttggtcgctcaggctggagtgcagtggtgcaatctcagctccgcctcccaggttcaagcgattctcctgcttcagcctccccagtacctaggtctataggcgcgtgccaccacgcccagctaatttttgtatttttagtagagatggagtttcaccatgttggccaggctggtcacaaactcctgacctcaagtgacccacctgcctcagcctcccaaagtgctgggattacaggcgtaagccacttcacccagccaacattttaaaaaatgccctctaaatcataaaaatgtccaacactaatttaaatttttccccttgaatcagtcagaatttctcctgtatagggatgcattctgaccgtagcacacattgggaaagtttccatttctacacagtggtggtgcttatacgctcctcagggaatgtaatcatactgctgaattaattgagctttaaaagactttgtcagtaaggaatttgataagggggaagaaaattaaacagggtcctaatattggcccactggaggagaactgaaataattaccgtgcagtttccaattccataatatcatgccagagtggctgaacaagctcacagaactatcattccctagctcaggttatggtcttagtaaatctcctgagtgtaacgtcttgaccaaaacagacaccagtggctatgaaaaagccttcacaatgaagtcacagggataaaataaaagcgacagtccaagttgaaatgccacacaagtcgggctttcatttaaggacaatgctttcctgcccctgtgcagagcctggtgtgcattagagatggatggctgatttcctagttaacctgtagcaggtggcacaactgtataactgggccctctagccataatcattttatttttctggtgcctgtcctttcccatttccccatccctaactcctctgatagttcagtaacttcatcttccttgttggtgcttggagtcatgactggaccatatttctggtgtattttatagcatcttgaatatcctggaataaagtttctaaataatgctaataatgaagtctcttgctgcctagaagtcttggagctaggagcttggctgcaaaactcaaagtaaaattcagaaaatggtgttgtcttggactgaatttaacagaaacaattcctgcttatgactgtagactagactgttaactgggccttgacatgggattggcttagcccctttatattggattaaaattgtatttttatatatacacacacccctgtgtgtatgtgggattgtgtgtgtgtgtgtgtgtgtatatatatatatatatatatatgtatgtatgtatctctctctatatatatacatacatattcttacatgtatgtatattttttcctgggatttgtcttaaaacattctagcaaagcaagaaactgaaagttgacattttccccctgaaatatgctctaatcaccagtgacagatttaaaaataaatggctgagctatttaacttggcaagattacacactcaagagcaggtttcataaatatttaacttatcatttccatattttatacatggcaagcattcacagaggcagtgagatctgtgtggagagagaaaagactgcattcagatagacctgagtttgaatccccattcaataccatcctcactagaagactgtcagcaggtattttcatctttctcagccttgttttctggtaaaatgggcaacaaattcacaaaccacaaggttattttgaaggttaaataaaatatcaaacaaataccattgatgacaagtacctgacacatgagagttgcttgggaaagtaagttatcttctcttttaccaatattcaagatactgtggagttgcttggcactggcagtatgagtacattctgccaacttacgtggcaagttgattaatggatatgaccattataacctggtcttagagagggttcagctaaccgttaaagatgcccagtttcactgtgcctgaagcctcccctcccactttcttggccctaaggaaaagtcctgatatccatcggttatttattttcaactcctgggattccttcccatgattacagtagtttgatctctcaatgtgacaagaaaagctgaattattgaagaaaaatctcccagtccttcaagtgtaatttttttagattaaaaggagcaaccgcatttagaatgcttatgctaaaatgtattcattgtttagttggaattcaaatgaactgggtgtcctgtaatttgtctagtaatcctacctgttctaggtttctgaaatcactgctttaaggcaggcccaatgcctttaaaccaatcactgggccccagtaagccttttatctggtaggtaagctgaataggggtggagtgtgtgtgtgtgtgtgtgtgtgtgtgtgtgtgtgtgtatgtgtgtgtgttcctattacaagtaataaatgaaaaagtcatctccattttctcaaagcagcatcaactttagaatgagaaagttgcataattgagatgagaacctaccactgtctttctgacctaggttatatacatttagcattgtacatacgtgtgcacccttctgcagtatacatctagactggcaattgacggagatatgctccaagagagcaaagcagtttctccttaagcctacttctagtctggcctgctaactacctattaatgtttttctgaaatttaaaattaaatgacactagagtgaaataagcaaccagcgattatagggaataaaaggtactctgaacacatgggagtgatgatagagtctatgcatcccaggcacaaccactgatcttccactatgcatgaataaaccttttaagactctcagctactttaaaatattttgcctttcccaaccttaaaatattttttcagatgatccctaggaaaaaacagtgtctggaaccacaagccattatgaaatccttattaagtacacatgtaggaaaggaaagtcatcaatgcatttcttggctaacacaaatgtagatcagaaagacttggagtaaaatctctgcaactttacacaaagtgaagaataccataatttgtatcaatatccatgctattcacgtgactgccctttcaccacttgagaatcgtgtaaaaatttgctcagctggaaaagaacatgacttctgaagaattttagagatgaccaaatgaaaacaaaaatttctcaaattactgtcttatgatagtgagaatgaaaaaaaaaagcacagataggaactagagccaaagatggattagaacagaaaaataaaagatgtttgaaaatgaaaatagaaaaatttccagtttctgattcaacatgtaagaagatcagaagttgtcattcccatacttatgacatgtaaaagttggacaaactaaaactcagggacttttcttggactcaccagacacctgagtttgtgaaaatgaattctgaaaaactagaggctgaaggaactgtacgtaagtactgtactctagttgataaagtactgtactctagttgataaagtacttattttccatggagatatgggttaacagttctgaaatcatatcatatatagtataattgaatgttttaagaaactgatggtagttggtggaagccagatttgttgaagtgagagtttagagatgagtaaggggaggagactagaatgatccatgtggtaattaatggagtagagttggatacaacagcatgaactcctatttagatcgacatatatatcaatgtttacatatggaaacatttatagatatgcatatatacatggaatagcatattcacatgcagatctttgccctgtcagttgagagagcctagaagcaacgacaccccagtatctatgagcacacctgtaactcagatcttggtttctaaaactattttccaatttttactggagccagggtcccttgaaaaaataagtggcttattctaggactacagcagggaatatacaagatgagctggagcagcttgccaggaaatataaaaaatgctaaaaaaatgacaatgatatgggcatgtcataatattcagaagccaactggaagagttcccaattttcaaagctggaacaatttgagcaacaaaataaagttagattggactgtaacccagtgtattaaatggaaatccatgtgcatatgttggtataaaaaatgattccataagtaaataaacgggaaaaatagacaaatctctcatgcagaaaaatttcaaataatttattttgctactccatctacataaataattgagatgaaacgtaacttcttactccttaaatgtaggctacacatagtgacttttcttccagagagcagtgtatggaaacagaaaaaaaaaaagtaacattacaattgagaaacctgacaagcacatgtcaagtaaggtgatcaaggttaatatcaacagtgataagtcatattgatatgctattataatagcactctatttctctggttttctctcagaaataaattaccctagtctagtcatgagaaaatcatcagccaagtcccgattgaggaacattctacaaaatacccaaccagtaattctcaaaagtgtcaaggtgattaaaaacaagaaatgtctgacaaactgtcataaacaaggagagcctgaggaaactattaaatgtgatgtggcattccagatgagggatttgaatagaaaaacagcattgtttaaaaactgaggaaatctgaatgaagtatagactttagttaatattgcttcagtgttgattcattcattgtgacgaacgtactgtactaatgtaagatgttgataggtgaaacttggtatggaatataagtgaaatttctctactatcttcacaataattctgtgagcctaaaactattctaaaataaaatatttaaacactacaaatagaataaagagaaaacatgtaaaccattatttatttcatcagtttacttgttttgaaaataattctgtgcttcttctatttcctgaattttataagaaataaatatgtgagaaaattcaacaaccagtactcaaccaagtcaggtgtgaagatactcacttttcatcttctttgcatcccaacataattatttcagctttagagaatgtggttttgttgaggcaaaagtatattttgaatgctgatgatgtaggtttgtgtggaattcctattaaggaatgatcaaatgatctggaaagtagcaactgtttttgagattcttatttaaagatttaaataatttcatggacattaaagtattttgtaaactatatagatttcagtataaatataaatcattgttatcgtgtatgaactcattaatttattttttcattaaaagataagcttttatacattgtcttctccacccccaccacccgccacctctctatatatatagagactggggggaagagaaccggaagaggatgtataatattctatatatatatatgtacatattttttaaccaagccctatgcactgaacagaactacaatttcagttttgaaactgtctttctgaactattttactcctcatcgggcagccccgtggaggttttactgtttaagttttacttcctatttctcctgagagtatagaatggcattgaaatggcagagccattcaaaccatctgaattgatccaatatttcaattcttccaacttttttggtgccttttaggataaggctatttctttacctatgtctgtctttcaggagcaggttcttgcatcagatcaattttgtgaactggtttgtttcacctgtgaatgagttacaggtcctgtatatcatggtccttctaggacccaccctcatcttgataaacagacgctggaggtttagatgcacctgtggatgatagaggacactcaactttgcaaatggaatgtgttgtctggaggatgccatcatagaaacatgtggttccacttagtatttagtgttttgaacagatattgaggagcaggagaccctgaaaggtctccatagtgagagtgtgccaaccagagggcatgttacttcttttttacattcagttgtctcactagcacctcaaactcaacatagccaagttgaaattatcatcctccttccatattgtcccatccccctattcctgatgaatgacatcaccatccatccattgaccaaattgcaatcgtatgagtcatctttgacacctcctcctctctctcatctgacttgcaatccccaaatccagttgattccaatgttcctaaacatctctcagagtattcaatgccatttgactcggcagggaaatgtgataaacaataaagctactgtaacagcttactaatattgaccaaaggtcatccccttccaatccattctccacagaacaaagccattctaaaatacaaagatgatcatgccacttcctgcaatctcccagccatgcccattgtatgactcctatgctgaatgactttaagtttctttaatattacatgctctctttcccactgtgggttctacagatgctgtttgctgtgtctgaaacatcctactgttcctctctccacttaccaactaagctttcatctttcatcctccacctaatctctactctcctttcaggatcatcagaggtattacctcttacaaatatctttccctgccttccaaatcctgtctccaaagcctggattatgtacttattataggttcccacattgcactcagtacattgtctccaccctctactagcttggaaaaatctgcgagagcaagaagtatgtctgttcatgttagagttacctctaatgcctgacttgatacctgacaacatagtgttgctcaatcaataattgtaaatacctgaattattaatgcatgaataaataaatgatttggtaaatatacaaatgtatgtattaaaaacaggagagaaagaaatggaaatatttgtataaccagaacatcaggcaattagcattaggaaagctttttttttcttgtttaagtaggttaaaacaggccttaaaagacaaaaaatcgtggaacattaagatctctctcctttcccccctcctccttctacctgtgtgtgtgtgtgcacgcatatgtgcacttgttaaaggtagagagagggccgggcacagaggtcaggtgggcgggttgcttgaggttaggagttcaagaccagcctggccaacatggtgaaaccccatctctactaaaaaatacaaaaattagctgggcatggtggcaggcacctgtcatcccagctactcaggaggctgagacacgagaattgcttgaagccaggaggcagtgagccgagatcatgccagtgtactccagcctgggcaacatagcgagactgtctcaaaaaaaaaaaaaaaaaaaaaaaggtagaaagagatggtgagagaaaattgttggcaagattccagtttctttccactagaaggcagaaagcactaaacaaatgtcaaggcagggacctaggtttccagaacccaaaaggagcattgggagtttgtcactgagacctcagaggcagagcccaagaccagaaccgaactattactatgcggacttgatgttcaatgaatcaatcgcctaagtatccctaaatgctccactaccctgtgcctctctacaaaccccattataattcattcccaagccatgatcagaattggctcatcagtttgtgcggtggtaatgaggaaggggtaggaagttgggattcagtgggtctaccataaggcagaagaggaagcaaatcagacacattccaatgatattatctgtttggttttgcccatatctgattttcgaagtcttctatgtactgaaatcaaatatctcacattaaaaaaaaaaaaaagcttttaaagattgtaggttgacacagcatagaatatcccttccttcttctagaccagtagcattcaaagctacctggtagtgtaattaagattttacatatttcaagcttcttcactgtaactcacagcagcttggaaggtaggagtaagcttcatgacaatgatcctctgcattttgatgggtacaagctgttctttgatatcatggacaccccagcttttcaaaagaagattcttggctgtttagcagttcagccaatccatgtaattgctttttccatgttacataagagtaaaagtctcctataattatagggataaaagagacttgatactttccagatcaccagagcaggaagaaagaagaaaagcatgactttttggagtgattactcatcacatgccagacacaatgctgaaaactttgtatccatcatatttttatgccacgaaaaccctgtacagaagacataagcacccccattttacagatgagggccctgagactaggggaagacaaagaattcctcaaagttagtttacttagtacaaattagaattggtctttaaactgactccaaggaggatggccttttttactctaccacatcccctctccaacactattggtttgattttctgttacagaagtacaggaagacagtgtttcttttctagctatgcaacaatgacatgtggtggttgaaagcatggcctctggagccagactgcctgtgaccatttactttttcttgaacttgaacttatactttagtttctctgtgccctaatcttctcaagtgcaactggggttaataatggtcccagcactgttgaaaggactaaatgactttgcacctataaagagctttgtattttaagtgctccataaatattcatgttgtagttgtcattgctattgttgttgtctgtgaggccttttcacagaggcatggcctcgcagaatagggacaagcatgctttaatgctactcctgtcttcttaattcccagtagcagaaaaactggaagactcctttgccaagggttattattttttaatcaatctacgtagggtttatacatagatgatgacagagagaggtaggtacagttatttatagcctgtgagtcattatgaaaagtcactctttctttgcttggtcagagcagtgagaatacatatatctgcaactccatgtgtgtagaactagcagcttaaactggaaagatgacctattgccttagtctttcccagagagaggcttgccctacacccccttttgcagcctgcccaggctaatgcaactagcgatggcaaggcaagcagggcaggctgccatgcattttaggggatttgagcagtcaggcagatcattcagggagagattgttttaaaggtttagctaaaagccatttatccacctcatttcaagcacagtattggctccaaagtacagttggtcctccatatccatgggttctgcatccatggattcaaccaactatggatagaaaatatttggaaaagaaaactccaccaagttccaaaaaacgaaacttgaatttgccatatgccaaatatatcaaatccacgctaatgaagtgatgtgtaggcattgtattaggtattataagtaattcaggaatgattgaaagtatataggaggatatgtgtaggctataggcaaataacacaccttgttgtataagagactttagtagccttcaagtttggtatctacaggggatcctggaatcaatccccaagcatatccagggacaactgtgctatattgtgatgaagttccaccacttagctttatagctgaggactacaagctccaattatcttagggaatattctggtgaccaaataaataaaaactttctaaaaagtgatagtcacttgagcatccaagaagtatctatcacatccttaagtcattccattttcctttatatctctctgggtgagccatcttgtcctgaatacaatttgtaatgccgggtaattacttcctgacagaaatttcttcccatttcattctctgtgtgttaagctcatttgattacaacaaacaaaacaaaattcagggacattgattaatgcaataagagcaaaataagtaattaaaattaacaagtttctaactttgaggcctggcctctctcacagagtctgtggcaatattaaagtgtgattctagcagaataaaaacagttcttgtctcctgaaatgtgaataatcctcagtagatctgcctttggattggacatccattgaacatgtctcaactgcactgtgtctctttgtctttattttctttatctttgggtcattcccccaattctaactgacctttgttatccttctggtctccagtttagttttctgggaagggctctccctggctcagttcctcagcaccatcactacttgagcagagcttttccacctgaagtgctcaaaggactgcccatctgtccttgctcagggacccccaacacggactgcaaggctttagaagttgaatccccagcacagagctctaatcataggtgccgcagaggccttgtctccttgctggtgctgaagggtggtggcttccatagcctgacagtctctttatttacccagcacaataaaggaactaacattattcttgtggcaattcaaaaaaatacttaaaaattagtttgagacattatttaaatttttattatacatcccctgacaaaataatttttatttatggaatgtatttttttattttactttaagttctgggatacatgtgtagaacatgcaggtttgttacataggtatacacgggctatggtggtttgctgcacctatcaacctgtcatcattatttctcctaatgctatccctcccctggcccccaccccctgacaggccctggtgtgtgatgttccccttcctgtgtccatgtgttctcattgttcaactcccacttatgagtgagagcatgtgctgtttggttttctgttcctgtattagtttgctgagaatgatggtttccagcttcatccatgtccctgcaaaggacatgaactcatcctttcatatggctgcatagtattccacagtgtatatgtgccacattttctttatgcagtctatcattgatgagcatttgggtttgttccaagtctttgctattgtgaacagtgctgcaataaacatacgtgtgcgtgtgtctttatagtagagtgatttataatcctttggctatatacccagtactgggatggttgggtcaaatggtatttctgtttctagatccttgaggaatcaccacactgtcatccacaatggttgaactaatttatactcccaccaacagtgtaaaagcattcctgtgtctccatatcctctccagcatctgttgtttcctaactttttaatgattgccattctaactggtatgagattgtatctcattgcagttttgatttgcatttctctaatgaccagtgatgatgagctttttttcatatgtttgctggctatataaatgtcttctgttgaggagtgtctgttcatatcctttgcctactttttgatgggtttttttttcttgtaaatttgtttaagttatttgtagattctgcatattagtgctttgtcagatggatagattgcaaaaattttttcccattctataggttgcctgttcactctgatgatagtttattttgctgtgcagaagctctttagtttagttagatcccatttgtcaattttggcttttgctgccattgcttttggtgttttagtcatgaagtctttgcccatgcctatgtcctggatggtattgcctaggttttcttctagggtttttatagttttaggtcttaagtttaagtctttaatccatcttgagttaatttttgtataaggtgtaatgaaggggtccagtttcagtttttctgcatatggctagccagttctcccaacaccatttatttttatctatttcagggatcagcaggtttttttttttttaaaagtaaatctcaaacttgttcaaagagtaaatatctaggctttgttgacttttactcaagtctgctattgtagtacaaaagcaaccatagacaatacaaacaaatagatgtggctgtactccaataaaactttatttacaaaagcagctgtgtttggcccctgggctgtaatctgtggagcctgatctttcccagtgcatgtgtacccatgctgtgctcacaccccctcacactccatacccattttgtacatctgtgttcctttgttgcctatattgcatagctcactaatctgagaaggctggatttcaccgaattgcatgggagtcccactgttgtcaagacactcatggtctgttaagtggaggaaaaacatgaactatctataggagaaccaatgtctcagaatcatcaacaaatgcatgcatttgggagaaatttctagtattctaaaatggatcgttttatcctagaaatggtgagaatggcactctcatcacacaaagcacacatatctgcttaggtacagacatttgctgaatccgaattataatgtcctcttctgccaaccctgtaagatgctcacatgctaatggtaggggtggaggaatggtatgaaacatgaaatatcttctgctttgacaactgtcttaactctgttgttctctcctaaaatgaagttgtgctttgagccactctatctaaaactaggctgtcatttctatgtcctaagggatgcaagtaccgttttacctttcagaaagcaaattttaaaacaatccccaggtataagatttatctttccgagcagaggatctgcaaacagtgcctgcggacgtgtttactggttaaattttattccaactatgagctactaagtcttccagcaattgttctttcttaacaagtttgtcttccttggtgactgatggtttctacttgttcacttgatcagtgtagcatttgattccaacagaaatgtgcagtggctcacccctgtaatcccagcactttgggaggccgaggcaagaggatcacttgaggtcaggagttcaataccagccaatgtggtgaaaccccatgtctactaaaaatacaaaaattagccaggcatggtggttggcacctgtaatcacagctatggtggctgaggcaggagaattgcttgaaggtgggaggcagaggttgcagtgagccgagattgtgccactgcactccagcctgggagacagaccgagactccatctcaaaaaaaaaaaaaaaggaaaaagaaaaaaaatgaatctttataatatacaacacaaagagggattttgatgggcttttagttctcgcagacccccctgctgggttgcctaaacttgtagtggcaatagagcatccagaatatctgcccatttcttccttaggtacatgagcttccctgtggctttagatcgttcataattgttgggttcatccaggagtgtcactttgtgaactttttctcaaggtaataacatgtgtgagtagcacgaggcattaaaagaaagaagagagatgggagtgtcctttagatgtcctcagtactgttgttagaacctgcacaccagttttttattcacagtttccccttgtgtggcaatttatttgcagtgtagctggtaatatttgtgacatagaatatgttatgctatgacgtacctactatggttagcatagtggtggaatttaagaagggatatttaattaatagaatttataaacaggactatctgtcttcagagacacttcagggataacgataaacttcagagatactgagaattgcaaggggatctcagtctaatgacttttgagtgccttttcggatgtgaacaaacccagcaatagggtggataatatgccttaactgggtccccaagatacttgattgtgtatattgtctggatgttcaggaacacatggtcttaatttcttagatgtctctattgtgtgtgccagtttagagttcagtctgggtgcatttatgttatatagttttttccatattttcttttagggtataggaacaaaacagtcagcaaaactgccaaggtgcttgcagatcaaagtgaagataaaaaatgagtggagtgattgcaacacaaggtgacacttgatccaatggaggttactttcactggctttcctagaagctcatactgggaaccccatctatgggactcgtggtgggtggtgggggatgacagaaaacttcctcttcatgaaaatcttaggtctaaatgacatgcttatagtttggtggatggattgagagaagcagggaggcctttccaggcagaaggaacaaaatgtactgtcatttggaagtgacagcaggatgcactgacaggagcctggagcagagtataggaggcgatggcaaaaagaaagactcacaggttaagacaggcccagggcatgaaggacaagcagccactgcacacatcccctccactaactgctttgttctgctccctcttgcagtaccaatactatccaatttttgtctatactagaaatttgggagccatgcccgatccaatttccttcatatcacccatttactccatcagcaggaatagaaagcttaccaactttatttacatattcatccatcctttattgataaaataaatttatttttgagatactttccatctgacttcaaggttaaataaatgttaatgaaggaggtaatgaagcaagacatgcttgaactttggagccagacacaatttgggttggaatcttgcctctacctttcaccttctgagtatataaccttgggaagctgtcttgggatcttcagacctcagaaaagagcacaaagaagttaattatatgttcctcagagtacctgccacagaattattaaatattcaatagtggaaattcctatatcctcacttctccttctagttttcatttctctcctgaaacttcgttcattgcattttgaaaccttcattgactcttctattggattttgaggtccttgagggccaaggttattgttagggcttttttgttttgctttgttgttgttttttaataaaacactttctgtgtttatgtttctagttttgctcagttttggtttgcacgggagtctcctgcagtctgccgtctgagtgcaagagggaggatgaatgatatccctttcagcttcctcaggtgtggggaaaagattaggaaaagagcaaacatttatggcaatctggagttacagcatgtgtttgagtcccaggtattttcctcatacatcgtttagcctctttgagcttttgtttcttcatttgtgaaatgaagataaaattcttctaccttatctggcctataggatcatccctggatatttgccttgaacagtttacagtcttagctcccacctgcccatgggaaggaccacagggatcttgtgcagcatccccaaatcttctgcagcagcactccaagttccatctccttctctccattccttcacctgctttccgacaggtttcattctgtggccagtactttgttttcctctctatggcggctgtttgaaatttaggattccgtaggacagccttcttactttgcaattctgacctcaccgctacacaccatagttcacattaccctcaccttcattaatgtctctaacagcaacaatacaaattgagtaaattcaatttagggtgattgagatgtcacctgtttttattctttccataaattcaagcaagatatgttaacaattgttcggatgtcataatgttatgctagaagttattgggctctttaattgaatgttctcttaatttgggcattggtaaggtaccaatttgagtatgcagacttgatagctgggtttgccaccaccctgagctagtagtgtatgtggatggcataaagaacatgttggatctttccacctctgactggggctctctgtggccagcatccaactcagcaggatcagatgattccggaaacactgactgcttctctcctgcaagctcacagtggagcgtctggcactccctgagatccctgccctgcatggctttttacacaaactgaacaaatcacattctctaaatgagagaagtgcagctctgttacatttcaatcttctaaagaggaggaaggtcactcgtcagagaccttgtggtcatcagcaaatagggtgatccaggatgaagacacacaggcagtaaatgacggtttcttcctcctctcccttctcctcctttccccttgatatccagtcttatcttctcccttcctttctaactctccttttccaatctgttcttcactcgcctttcttctcttctcttctttcccttcttctctccctctttattcttcttccagaaatctttaaatgagtcatgattcaagtgaaaaaagattcttagctaactcacatatggaagcagcaaattttctcagattttgagctccttgaaagctgagcagcataggagccttcacaaccctgtagtccaggcagcagtagaggcatttctctccagttcctgggaatctcatccgacagtcaacttgtgttgacagagtgagtaggactgtggcttttatttatttatttatttatttatttgcatctggatcttgggaagtaagcatgtggcataagctgggtttcttacattgccctaagtcattgtcacaagtagaaagaagtatggttgtacctctgctgcacaaccactcaggcaactgttcctaatgtcttctctgaggccttctttgtcacttcccaagtctcaggtatgggcaaattatcctctatcctaccccattatatttgaattccaatttgctcgtagttcattaacacctaccacactatttcctatttattttgtgtccattcgccagctagattgcagaagttgtgtaattgtgcctcattcgtctttatagccaaagtataatcctagaacagtttctaatgtcagatgcatcagggaacccaataaatgtagatggtaacgttatgctaatcttacattttaattctattagtggtgaaatctttatgacttagtcctgtgagttgcattgaaagattgatctaagcacctcttttgtgttggaaaggagatatattttcaaaatttttaaatattaatacatttttagcatggcatatgatcgttttgaaatacttatttcaatatcccatgttctaaaatagagtgtattaacagaaattttgagatgtggtaaggccaactgatcatgaaatgattgccattgaaaagataatggtcttgagtatggaatcccaaaaaaggaggtaaatgggggtctgggctctggattgggttggtttttatttgaaaagtgtgtgctcgggcaatttattttctatctctaggaactggttagtcctgagaggggaaattccttcagggtcaggaagaaccagatatcaaagaatcagaaatacaaaataaaagatagacttaatgcagcttatgatgccaaaagagattcacttttctctaaacatgaatgggcatgtagaaaaaacagcaatctctacagctgtctgggtacaattgctgtcacaagaactattgccataatgcggttaggacataaagtaaacttaaatactctacatactttttataattggaggttgtctacatagacacagtagagacttgagaagtccccagagaccttaaaattctattcagttcagctgtaaccgtatcctccaatcaccttgtgggtcatgtatggattgtcttgcttctgcatttatcttccagagatttgctgcttttactaattattggagtagcagacacctctattgcttctgcctctcttgaactatgattgttcttatctctgggtactaagtccatcatccttagatcctgtagagcactggctgctgaggcacacttatcaccaaacgcctgttggtgtcactacagagtaggaaccaaattgctctcactgctggatgacaacttgtttctcatctagcatcctaacttatctggtaaggaaatggataactgcagtatataattattgtgtatcagtaattaactcctcctgccctctgtttaggtaaaagagatgaggcttaaaaggcgcacaatttttaaatgtcaaaagtatcacttgactcaaatctttctgaacttagcacttacaaacttttcagtggaccacaatgtccaacattaaatgctggaaatcaccataccgtgggtttgtaaaacaggccaatattttttttatggatacttttaaggtccatcctagaggcctatttatataaacacttcatgccttactctgggaacttatcactaagattttcttcaaagacctggtgaatcaggattttccattcatatctgtgaattaaggatacctgggggtaatctctgtcactgaatacatcaatatatttgccagttagacctcttctttgctggagaatgctgacttgcactttttgtataggtaaggtttatcaacaagatttgtacaaggtcaagattgggagagctgttagtctgagaaatgccaaatatcagaatggggaagaacgagatcgtctctagaactcctagttactcagaggcattttatttcatttctttcatatgatttcttctttctttctttgttgtcttttccacacaccttacagatgatcagtattctatttaaaatgtacttaccacaagtacacaaggctctttatctcaacagtgattatagttaggcaatagtagaaataaaataaatgtccatatgactttaccatatgacagaatattctgcagccacttaaaaggatgagatagacctatgagcactaacataaacaacgcccatgacttattacaagttttagaaaacaggtaatctattatttataatagcaaaaaatgataacagtaattctatgttattatttttctctttttttttaaacggagtctcgctctgtcacccaggctggagtgcagagtgcagtggcgcgatctcagctaactgaaacctctgcctcctgggttcaagcgattctcctgtctcaacctcccatgtagctgggactacaggtgcgtgccaccacgcctggataatttttttttatttttaatagaaacaatgataaatgagccatagctacctgcaacaacatattgaatcttataacataatactgagcaaaaaaaaaaaatctagacatataaagaacatatggtatgattctatttacataaagatcaaaaatagatacaactagcttttggtattagatgtcagtttaatagttacatgggtagagaaggtggctagtaattaggaagcagtgtatacaggggtatggatcatattccatttcttggtctgagcattgagtacctatgtgtgttcattttgtaaaattttctcacagtgtaaatttatgaattatgcatttttgttatgtattaacctttaaagtttattgtaaagggcaggaatttgaattttgaaaaaataaaagattgtgatgtttcacaacatggacagtaatgaaaggatattcttaggtgaagtaagagatgtggttcagcaagaccatgtgcaagtcagattccaggggaactagaaaccatgagcatgggtgaaactgaagacattattaagtaaaataagccaggcaaagcaagacaaataccacatgatatatggaatctaaaaaaagctgttctcatggaaattgagaatagaatgatggttatgagaggccatagggtttagggggaagatggggtcggggagatgttggtcaaataatacatatctgcagttggatagaaggaataagttcaagagacctattgtgcagcagggcagctatagtcaatgatgatattttgtattgttgaaaaatgcccatagagtgtatattcagtcttttccccacaaaaatgataaccatgtgaggtaatgtgtttgttaatcagctcgatttaaccattccacaatgtatatatacttcaaaacattgtacacaataaacacatataatttcatatgtcaatttaaaaataagtaaatatatttaaaaaaattaaaaagacactatgagcaagtagaggaagacaactgttaaacataggagtaggttacaaagcaggcagtggaggggcagggataacaaaatctccaagaagaggggtgagccatgctattggatttccatctgtagtttacatatatccttaagataaatctttgaaaaatcaagttaaaatgaattaagttgaatattatcagcactgatatttataaaagagattatatatttattattgctgtgactatcattattatgattcgtggagcatcagtatgactctgtacctgaaactaatgagtttgactacaacactcttttaattcttcatttttcttatgcacttgaggaattggaaattgttttcaaatagtttacatgttacctctcaaattcagtttttacaatgggttctatgatatattaaaataatggtaataatatagtagaaaccaattatattttattaacactggaagtgagccagacactgtgctcagtaaatgcatggtacaaagcatctcatttaatcttccagtgacccagtaggcagatattatgatcatcaccacatttcacatcaaaaactgagtcatagacaggttaaataaaattgccgaaagtcaggtaaatagagcgagaccctgggaacagatctgtgctttccgactatcagtctgcactattcaacgtggtagccacaaacatgtgatggtcattaaaagaaaaactggagaaaagttaaatttaacagactttaatagagcaatttgtgaaggggtagccctctgcaccaaattacattcagagtgactttggcactgccggaaggtgtaagagaatttacggaagcagggaatttatgggagaagggaaagtggcctacagaaaacagaagtgaggtacagaaacagctggttatagtaactcggcattcatttgaacacagtttgaacagttgactgactgtgattagctgaaactcagtgattggtacaggagtaggttacagtctatttgggcatattgttaggttaaaattcactatgtacagagaaaccattagaccaaacttagaatctgtaaggaggcagttttagggtaaaatcagcacagttgaacacttgaaacatggctagcctgaaatgagctgtaagtctcatatacggtaagtctcatataaaaagccccactggatttcaaagacttagcgccaaaacaatataaaatatttcattaatattttatagctattctgtattgaagtgatactattttatatatgttgggtcaaataaaatgtataattaaagcgaatttctcccttgattgactgattgattgattggattgcttctacggtgcctactagaaagctttggaagctgaaattatacatgtggcttgcattatatttctgttggatcatgctggtccagactggatgctctacttctagacctgaggttttcaacttcagcgctttaggtagatttgaacgtacacagatctagcttcctagtgctggaaattcagatctgctctgggctggggttcagttgttggtgtatttgagaagctcccgaggtgtttctaatgtatagccagaggagagaacccctgcctggagtccatatgcctgctctatgcagtctgatatccacctgactcgagacagctcctgatgggatagttacaacttaagcctgggaagtcaaatagccacagggctctcagcctgcgcacctatgcaaagagctgactttgctgattatgtttgtagatcttccaggatcactgccaatacctgtggtaaaggagttagattcctttagcttacacctcatctgtctgagagaagtgaagccccattacaccaatatggagaaggttgtgtgttaccttggtcctgaatgttctgtgaagcaaagttaaacggtctttagtgggttagaatccctactccatctaaataggtcacagctagaagattcccttaaaccgctgggtcagattctccctgttgtcaagaaaatgaaatgttattgttccaagtcacatgtcttgctcctagaatgtgactttgccaatgaacagtgaatcctaagtgataaaacctagaattgagggtaaggagtgggggacagctattataggttcaggaaaaatggagttaacagatcttttaaaagtgaactcggacaccacagactgggattatcttagcattgaaaactcactggtagatataacttgatgcaggttgctttttacttataatttatttgtggaagaaatagcacttggaaagccagtgcatattagacatattaatgagaagacccagggcttttcattttcttttcaaaatatgtcttataacattcacttatctatagtcagccagagatgcactgtttgtgaaaggaggggaggagataagcggttattacaggaaaggtttatatttggtgggggtgcaggggaagaaaggaaaatgacaggctgagaatacagatgtttatgaatttaaactgttatttacccttaaatatcaactttaactgataatgcacatctaaaagcattttgcgtagaaataagataaactatagagtatcaacattattataaagtaattatttcagtttttcctttgttgttgttgttgtttgttgttgttgttattggttttttgttgttgttgttgttgtttgagacggagcctccctctgtcacccaggctggagtgcagtggtgcaatctgctcactgcaagctccgcctcccgggttcacgcctttctcctgcctcagccttccgagtagctgggactacaggcgcccaccaccacgccctgctaatttttcgtatttttagtagagatggggtttcatcgtgttagccaggatggtctccatctcctgacctcgtgatccacccgcctcggcctcccgaagtgctgagattacgggtgtgagccacggcgccccacctttcaatgtttttttaagtgtagtattatgcagttgactgcaaagagcaagaaaatgaatccctagggtaaatgtaactttctacctcctcccccacctcaagaaattgctgcctctttttattgccccaccaagcagaagaccactggtaaatgtccttagacatccagctcagaagctattgagttcaccagaggcttttgtagtgaggccctagtgcacagccagcattagccacatacaactatccagaaataaagatcatatccttgtccttgaggggcttttgagaaatgggtatgtgcatttttggtacaagaccatgcagttatggaaaaggtgcaaaaggaatgcagaagggaagcttgggaagaattttcaggcttaatagtatttattctgagcttttagggatcggtgggcagattaacttgctagggctgctgtaacaaagcaccacaaactggtggctcacacaattcttttgttttccagttcttatcgaggtattagcagacttggtttcttctgagggctgtgaaggggtaactctttcttgcctctttcttagcttctggtaattggctgtcactctttgatgttcctaagcttgtagaatcattgccctaatctctgacttcatctttagatgatgttctccctatgtgtgtatgtgtctatctctgtgtccaaatttctccttttactaaggacacagtaatattggattaggatccattttcatgacctcatcttaacttgatcctcttcaaagaccctttcttagtccatctgggctgcataacaaagtaccctacactgcatagcttataaacaacaggcatttatttgtcagttctggaggctgggaagaccagggtcaagatgccagtaaattgggtgtttggtgaaagctcagtctctgcttcataaatgatgccttcttgttgtaccctcacatggtagaaggggcagggagcttccttgagtttattttataagagcagtaatcctatctgtgagggtggagccctcatgacttacccacttcccaaaagccccacctcttaatatgattccatagggcattaggtactaacatatgcattttgggggcacaccaatattcagaccatagcagacgctatactcaaataaggtcatatgcatatagctactggagtcattacttcaacatcttttggaagacaaaattcaatccataacagtgggagtttcaagtagaaaaagggaaggtgcttctagcctgaataacacagtgtaaaagacatggagccttttagtacctcctggtcatctcagcttctctgcacttggatggtgggactggaggccccccacccccaggcagctttctcagggttgcttgtagcaaggctcagggagctggttctgtcttcctgatattcttattatatgcccaccctgccagggtgccaccctctgtaactgccccaccctgccagtgtatgtttgatctcattgatctcatggtaaggattccttttatttgccttcaggctctcttttaactaaatgaaatacttgtttaaggcatttataaggccattgaactctttgttcatttttatctgcaagttaaaaaaagcatatcctgatttctaaacattctaaatattctccttttcattctcttttctgatcaaggttcatttgcaactgcttataagctcctaatattttaatctatcccaagcatttgttgatttttaaaaataaaattcaggagacctgctttatctaacaataattaatgctggattaaatgcacttaaacttaatccagttaaaatgaggacaaaaaagtcagagtgcaaccattagggagagactgacctacacagatgatgaggttggtttgatggatagaaataaatactagaattaggcagggagaaatgctggagtgaagactcatttcataaatagtgggttcgttattgaatattgttgtattatgatgacttttgcttctctatgtagactcttaacttcagggcctcagataatgaatacttggatagaaaggagcctctgaggtatagttggttgatttttagaatgactataagagtaatcatgcttcattttgatacctagtggcaacacataggatctgatttgcatatcttgagtatgcgggtttccaggtgaaacttttgcttacttatatgacatataggtttgtgtgtgtgtgtgtgtgtgtgtgtgtgtgcttcaacctcacactacttgaagatcagcacatttatggacatcatagttgagctcagtgtcttttaggccaccctaaaaatggtggtacaaaggaaatgttctcaagaagcactagaatcctaggtccctatacctggaggggatatggaggtgccatttagaacagttcctgttccctcacacatgtaggagatcatgctgtatcatggtctcccacacctctgtcctccatacagagatctctctggggaaatagtgtaacaagaactatgactgtgattttctttcggtagcattcttttttctacgtagtacagcttaacaagtttctatggagagactttgagaattttatactgttgcagtttccaaaagaattaccataaggctgtgttacacatctggatctgaactatggctgcccagttaagtagatatcatgctagccaataagtgttccaaggattctgtgtctccaaggacaaagagcacaatttatttttcttaaagggagaagtgagggagagtatgaaactagagaaagtaacattatggtgaaatttcagaacccagcattagaacagtggagagaatctttttggcaggcagcctggcctgagccttgcccttgcccttgccctggactcatctcactccaggactcatctcactccaggagcagaatgcatggttgttgcatgcgtctgtttcaccaccagctgtaactgctcttatcctcttatccattgtctttaccaagaaaatggaagaaatactacacacttcctatttgtttatctgtgagggagagtgtgaaagacagagcccattccccaaagaggtctgcttgtattacatccctcaaaatttctgggcaggaaattcaaaaccacaattgagaaatatagttaccaagagtgaaagtacaagttaaaaaaaatgagttaaaaaaaaaagacataaaaataaattccttaaataccagtttctggacacagacttctccagagttagcaagtcactgactgcctgtggctaaggctagttttgcatatgggagtagaatattttaaaggttctttttgacttaatgctgcttcaagagaaaacggaaaaaggaaagaaactggcgttttgtgcatcatttatatgccatgtattattctaggcactttgttcgtgcttatgtgtttaatccctaaacatgcaggtatgcaatgtttttctattttattggtaaggacaatgaataagaggataagaacagttgcagctgatggtaaaagtcaggcatgcataaccacggaccacactgctccttgagtggagttggctcagggtaaggggtgatcttagccaggccacccttggtggcatggctcaatccaagttcaaaggcctcagaaccagggaagccaatgatgtgattctcagtctgaggccaaaggcttgagaacccaaggtcattgatttaagttatagggtccaaaggccagggaacctggaatttttgtccaagaacaggaaaggaggagtatatctcagttcaacaaatagatcaacatatttgcattttctctcattttgttctcttcaggatcccagaagatgggatggtgcctgcccatattgaagtcagattttccccatctagtccacttagatgaacatgctaatgtcctctgaaaacatctacacagacataccccaaaataatgctttattaggtttctaggtattccatgttccagtcaagttgacacctaaaattagccatcacacaggggggaaaaattttaaaatatagaaagatgaaaaaccagaatttatcgaattactatgtgctatatgcttaagaaaccttacttgatatcattctcattataaacatacttgatattgcctttatgtagggaggaaattgaagtttataaaggtaaagtagcatacttgcagtcactcattttaaaagtgaccaaaattaaagtcaaatccaaaattaccagactctcagccccttgatttatgctggttctcgcataataccctatgaatcaaatgcactgataatataccatcattgtagctacacctgggtctataaattcacttgtagtctttgtagttttaatttcactcttgatttaaactcagaacctttttttatttttgcatgtccccaggctacatttgactagcttcaagtaaaaaacaaaacaaaacaaaaaacatactgcataaatgttatgtggaaataattcatttttgtgagtgcagtcttatgtttttgtttgttttagtgggcattattctccataatttttataattctttttatttgcagaagcagggtagacagattattatacgcaagtcatgcttattccatttcagtcatgaactgacaattaagtaaaatggaattcttaagagttggcacaaatatttatttgtttccaagttcaactggaaaatttaatgaacttgcaaatgtgggggtggaaaggatgacattttttaagatgatgatatgcctaaacaggtcttaataatacatgttttatcccttcaatttgaatctttccaactttaaaatgtcaacccaagcctgctggggcacatgattgcccctctcgacttactaagaaatgtagacaatgtgatattttttaggtttactttctgttttctattatgccagcccaaataaatgcattaaaaacaaaaataaaccctaagaagagagaaaatgttcgaaaacatttgttcccaacataattccacaggaaaaagtattagaaaacatgaggtcatatcttaagagaggatatagtgcatggtctcagaaaatagaagaaataaaggaaaataggtcctagaatgtgggctctctacatgtaggttttgatccagatttgtttcatcaggcttccatttgcttattaatgataaagtactgcaagtacctttactggtagagaaacaccacaagtccccatggactaatttcagctgaccctggaagcttctgcagcattttgggagcaccccagaaagtcacggtatgaagaattttgtgtacctgagccacccctcagcttgcttttctgtctttgaattgccatcagcaccaaatgaagctagtctagaatataaaaccaggcagcataccagtgtcagcattagagtatgttggttggaacagcacacaaatccaacacagagataaacaatcagaatacctacatatcagttgatcatgctgctcatcctctgaggccagggtacaagtgctttcaccattttccttatggttctttgtgctgtgaaaaggactttgtgagtgcagaatcacagtgaggagaccaaggttggatgaaaagtcccctgttttagcctataactgaataccacaaaatgggtactttattttgaaaaaagaaatttatttggttcatgtttctggaggctgggaagtccaaaagcatagcgccagcatctggtgagggcagttctatggcagaagggggaaggcaagtgagctcaggagacagagagaggaaattgagctgaattcatcctcttatcagaagcccactcttgtgataactaaccccctcctgtgataactaaccccctcctgtgataactagtttactctcatgataacagtattaatcccttcatgagtggagccttcattgcctaatcacctcataaaggccccacttcttagtactgttacaatgactattcaatttccaacacaggaactttgaggaacatattgaaaccatagcagctccaaatggagaagctgggtacagagtttggatgtgggtggggtcagaagcagatggtcaactcacgaaaggaggatgtgtttaagcctaggagtacctgatatcaacatggacagattctaagccttaagaacactctggggtgagaattgatgtaacatgaacaattctgtaaagacagaaatatgcatttgttaattcaagtaacaagtctgaagtgtcaatgatgtgggaattgctgcactaggtgctgaggagataatgatgagccaaatgagtaaattaatgaagaatatggtcccctgaatcagtggagcttactgtgcaaggctttttgatagtgcaaggctctttgaactagtgacatttaatttgagatttaaaaaaaaaaaaaaaaagtggagtggtcctttaaaagacaagcagaaggcgtggagcattggctcgcgcctgtaatcccagcactttggaaggccaaggtgggtggatcacaaggtcaagagatcgagactagcctggccaagattgtgaaacccggtctctactaaaaacacaaaaattagctgggcatggtggcacgcacctgtagtcccagctgctcgggaggctgaggcaggaaaatcgcttgaacccaagacagggatgttgcagtgagctgagaccataccactgcactccaggctggtgacagagcaggactctgcctcaaaaaaaaaaagccagcagaagaataaagcaaacagcatgtttcaagactctaaggactgaaatggtagacataacagaaaaaaaggagagtggttgatatgggtgagcagtgtcatatcaggcaggtctttcagaccatactaagaattttaggtattataagtcaaataggaacctaataacacagtaaaaatagaatatacacacatattcattcatatacatgcatatatatgatttaatttatatattaaaaggtttatattgcctgctacatggagaatggtttatgggagtataatcataaaagaagactaaaagataaaaagctatgtattattttatattctgcatattcgacatattctttgcatattctttgtattcttttgtaccctaggattaatatttttgcagctatagttgacataagataagccacctgtttataatgtatcactagatacatttttgacataagtattcaccagtgaaaccaccactgtaattgagacgattaacatgtctgtaactcccaaaagtttccccacatcaatttgtaatctctcctatcagtccctactcctgtccccaggtatctacatacatgttttatgttattatagtttccattgtctagaattttgaataagtggaattatacaacatgtaccctgtttgctgtctgatttattgcactcagcatatttattctgatattcttccatattgtagtttctatcaatagttcatttctttttactgctgagtactatttcattatatagaaatgtaataatttgattatccatttacctgttgatggatccttgggttatttccagtttggggggctattaaaaataaagtttctatgaacattgggtacccagtgaaattgaactttcaatagttgttggtaatggaatggcgagatcataaagtaggtatatttttaattttctgtgaagctactattggaaatggctatataattttacctttccatcagaagtacatgagagttctagttgttcacatccttttcacatttggtatggtaagtctttaatctcacctattctagcgggggtgccatatatctcattataatttaatttgcaatttaataataatgaacaatgttgggtatctttttaggtacttatttgtcatccagatatctttggggaagtgtctattcaactatgttttgctcacatttaaattggtttgcttatcttattattgagaagtcattcttataaattaaagatacaagtccattgttgaatacatattttgcaattttttcagactgtatcttgccttttgattttcataatggtgtctttgaagagcaaatgttaatgttgatagataaagtccattttattgattttgaaatattttctagtttgtagcttttatattttagttaagaaatctttgccaaatccatggcactaagattttttcctatgttttcttctaattttgtagtttaaactttacatttacatctatcatcctttttgagtgtatatatgtatagagtatgagattaggatccaggttcatttttgtggatatggctatatatactattgatgcaatgtcattttttgaaaatattctttcaccattgaattatgttggcatctttgtcaaaaccaattggccacataagtttcgaatattatatttcagaacgcttttatctgttgcaattatttatttgtctataattaggccaataccatatgccttgattactacagctttataagaaatcttgaaataaagtcatgagattccacaactttgttctcttggctacaggaacgttgttttggctactgtagatcttttgtatttccataaaacatttagaattggcttgtcaacttctgtgacaagaacaacaaaaacaaaaatgcttcctgagattttaatagcattgcaatcaatctgtctatcatcttggggagaattgacatcttaataatatcaagccttctaatccataaacatgttatatctatttatttagatcttcttttaagcttttcaatgtacaagacttgtgtgccttttgttaaattgatctctatgtattttacatgctttgatgctattgtaaatgacatttttgtttcaatttttctttgttgctgtaaaatgatgtacatttatttttgtatctctctcctataaccttgtatcctgaaattttcctaagcttacttgataattatactaggtcttctgtagattccatcagcttttctgtataaattgtcatgttgtttgcaaacaaagacaacttttcttctactttccccagctgaatgatttttattcctattttttcttgttacattaactaaacctctggtacagtgttgaccagaaggtatgagagtggatattcttgctttattcctgatcttagggaaaaaaacattctttcacagctagatatagattttttatagctactctttattaggttgaggaagtgccttctatttctaggttttgagagttttaatcaagaatgaatattaagtttggctatgtttttgcctctgatctagttgttaaattatctgcttagatgtaaaaatggtgaatcacattgattaattttaaaatattaaaccaaccttgcatttttgtgtataaaccttacttagtcatgatgcactatactttttatatattgttgtattttatttcctaaaatttattaagatttttgcatctgtggcaatgagggctatttatctgtaatttttggttaggtcttcgtctttttcggaatcatgataatactggcatcataaaatgaatttgaatcgattgtttttctttaattttcagtgatgagaagcccccgagatgataggaaacaatgaacaccaaaggaattattattttatttaaaaaatagtgcttgctataattgaataatgttctaattttagtatgcatgagaaatacctgaaaattttacttaaatagagatcctggctgggtgtggtggctcacacctgtaatcccagcactttgggaggccgaggcaggcagatcagctgaggtcaggagttcgagaccagtctggccaacacagtgaaacctcatctctactaaaagtacaaaaagtagctaagcatggtggcaggtgcctatagtcctagctacttgggaggctgaagcaggaggatcacgtgaacccaggaggaagaggttgcagtaagctgggatcacgccactgcactccagcctgggtgacagagcaagactctatatcaaaaacaaaaacaaaaccaaaaaaaaaaccaaaaagatcctgatttagaaagaaggaaaccataactagtattaacaaagaaaaacatatctcctcaggtgattttttatgtagatgattcatgttttgagaactcttagtctgctcaaaagttctcaaagtgtgtttctcagaccagtagcatcagaatcacctgggaactttttaaaaatgccgacattctgtactcactccagatctactaaatcagtaactctggggaaagaagtaggtgcagtctgttttttattaggctccaaggtgactccagtgcattacaatttgagaactattgttctatgttaatgacacagagagagaatgtatatagatgcaattaattttgtatatttttagaatatatatgtgttaaatagtgggaaatttcctctaaattggctgcttgtttcttatgacctgtatagaaggtctgagagtgagagagggaaagttgtgtcaggtgtgtgagtagtgtggagacgatatggctgatcattagggaaacaggaaggcaggctgatgacattgttagtgaccattagatgactacttaagctctgtgattgctgttctttattggtgtccatttgcccagtggtacagttttcttcccccattctgagctgcccacagtagaggtatggagaaggcagtttcttggatttgtgtccatttattttgccaaataggtagaagggaagacaaaagggataaagtaaatagagtatttgcaagagagtaaatgactgtagtcatggaccatggtcactgtcctatataaacagaaagatgaagacaagacgaggataattaacagagaaactgctgggttctacggatacaaagtcttgatgagatggaagaattgtttaggtagatacaggttaagaaaggacctaggagtataaatggtagtggctacagagtgaaatgtttgtttttgaattattgtcattttcgtgataagctacaaggtatgaccttggtaatagaggctgagttctactgtgccaaatcattggtattgagaaggacagagactgggtgaataaaatacttacgtgcctattgattttttcttcatgagtgatgtcaatcatagtgatagtaggaagaatgggaggctgacagccaaggactaaatcagaatcagaaaacacaggggcatcagcaccacagaaggtaaattagaaggcatcactgccacaggaaagctcagaagcacctgagtttgtttctctagctgattaatttgggccttaccacaatttcacaggcttatgtccccagtaaatcctaaagtcatagaatgtcttttgatgataaatctgtaatcgcaatatctgagtatgagttctgatgtagccatgcagatacaaataatagcaaccagttatcctgtagaactttgcaaagtaattgaatcataataagttccttgttttttccctatttatgacagaaaccaaaaagttggctttgaaagactcctaccagctcagaagtacatggatgaagatagttgctgatgcaccccgctagcatccattctaattttgtttttcaaattcacagagagtgaagaagtttatcaaaggcaggtgctgtcaatttcatgtatcatctttggaattgtcatcgtgggcatgttctgtgcagcattctacttcaaaagcaagtaagactatttctctcaagtgtttaaaggttacttttagagaaagcgctttgtgttactttaagttctcagtctgtgtgccacacagagggaacctgtggaaatgggtctagcaacaatctgcaagtgacttaggacatttttgtaaattgtggtgagtgtgtacaggcatgtacatgcatgtatgtgatgtgtatgtgcacacatgtgtgcgcggtttatctacgatgcacataatgatcattcctctcagtgaccacgaacattctatgttctttgcactgattcaccacttgctggtattaagggcttggtgtctgcctgtcactaaaggctaactcttctgaacaaaggggccactgctatgaacctgcacattatcaaccattatctatctatttctgaaaaaacaattcagtttttcataaagattttaggcaaatgtggaatatgaatactaaaaaatatacttcagtttaccagttggtatgcacatgttgaatatgccctaaagttaccttgctgagaaactagaccttcttcagataaaggtgtttatgtttgactagaaatagatgtaggccaggtgcagtggctcagcctgtaatcccagcacgttgaggggccgaggcaagtggatcacctgaggtcaggagttcaagaccagcctgaccaatatggtgaaaccccatctctaggaaaaatacaaaaattagttgggcatggtggcgtgccactgtagtcccacctacttgggaggctgagacaggagaattgcttgaacctgggaggtggaagttgcagtgagcccagatcacactgctacactgcagcctcggggacagagttgtctcaaaaaaaaaaaaaaagtagatataaacgtctctctctctctctctctgtgtgtgtgtgtgtgtgtgtgtgtgtgtgtgtgtgtgtgtgtgtgtgtatttttccaaatgaactctggtagacgtatttcatttattaaaatgatataatctgcacttaagaaatgcagataaaaatattagccccttggtttctcatgtcttaagaattttgcacagatttggttcctacagcttgtctgaaattcaagccaatgtgtaattgcttttcagtggacctataattttttaccaatttgctcttctaacatgggattaatttccaggtatagtttgtgatacctgtctgcatgttatctgtgttgattctcaaagaaaactgtgattatgattttttaaaataacagaaacttgagcatcaattcagaattagtaactattatcttcctaataaactatttcagaatgttttttagatatttagaactgttgcaaaaatagaacagacagtttctatataccttagaccaaagttcctccattattaatgccttacattagcatggtacatttgtcacaattaatggaacaatattgatatagtattactaactaaagtctgtattttcagatttccttagtattttacctaaggcccttttgttaatgccagggccccatccttaccatatgatattagctgttacatctcctaggcaactcttggctgtggcagttgtaactatcaatttctgaacacttactctttgccaggcacactgggcttcttatgtgttagcttccaatcaccacagaaatcagagttgtgcattattactgcatttttcaaataataccagaatttattttaaaatgtttatttttcaaagtcataaagaagaaaatgacagataggttctttaattttaggagttctagtttaaatcacatgctctaaacctctataccatactggttcacatagtccttctgctagatggtggagctgcgcagagcgagttaggagttactctcttttgtgcagcccatagcactttatgttctccaagaatgccatctggcataatggtcagggttgtacactagtgagtcatacttggattcaaatcttcaggctgtcatttacttgttatatttgattaggcaaattatatcgtgtctcttagccttggttccctttgtggtaaaatatgaacaagtataatatctaccttatagaattttgttaaggattaaatgcaatcatggccagacgcggtgactcatgcctgtaatcccagcactttgggaggctgaggcaggaagatcacttgagaccagcctggccaacatggtgaaattccatctctactaaaaatacaaaaatgagccaggcatggtggtgagcacctgtaatctcagctactcgggaggctgaggcacaagaatggcttgagcctgggaggtggaggttgcagtgagccaagatcgcacgactgcactccaacctaggcaacagagtgagattcagtctcaaaaaaaaaaaaacaatgcaatcacagtgtaaagggcatagcaaagtgtttaaaagagtaaatacccaatggaggcttgctgtcgttaacacccatggttttccacactagaacttggaggctgggtagctataaagttaagagcctcccctggagcacgagagtggtaatcacacccagcagggtggtagttagaagtgtctccctgctagagctttgtacaagaaagaaattccttacttaacaataaccaaattacaataaagaagcagttaatcacttatttttacagtataatgtgtagttgtaccacatttaaatgaaagacagatcatggtaattatgaaagcaaacagctggattaccaggggacttccatctttggggctgtcaatgtctcactctggacagcaagagggctctgagatcaacatctcctcctgggactcagtgaggagtcaaagtgtttaatgaaaacaatcttcaacatcagattcattagggtaggctcagaggactgcacagaagctagagcaccaagcgggacattgttatctttctgtctaccagcctgggacacagttttatttaaaaaatgaatcaattaataactaaaggcaaaaatgataaaatgatgatacaaatggaagtattttccacctgaaattggattagctatatgttcctcattagaggcctagggtgcatttccttcttctagtaccattttcaggcttggtctcccttttttttctttgcttgagagaaatgccaccaccttaccaagcacctaatttatattgctaaaagcaatatagattgtcataaaaccctggcacaagttgtgtgtgtgtgtgtgtgtgtgtgtgtgtgaattcgtggatttccttttccaaaaccttggggagaacagaatatccaaactctaccttgaccttcccttactttcactcataaaggaaagtagtttatatgcatatacattttttactttagcttagaagccccaagtcttccaggattctaaggcctctctatcactggtattcaaataagttcacttgaacctccattcgatacactgggatgtatagtttctgcccagagggagctgagacttagctcaaagctctcttgatcatttatgttctacttcccataatcacttagaccttgcctttatgattctttttccattccctcgtcacctttggcatggcatgacttcatcagaaggaatattacagcaaattctgtgtctgaggaaagatggaaggtaggtaacatgataaggaataagtaagaaacaccttgaatttagaggattttttgatggagttaactgaacccatagcaactctaaaaaacagtgaaagaaattctcttcactcccaataagctcatatattcctatacatagttaatagaactattaattgagcctgtcaagtctggccagtgtggctcacgcaatgactgtaaattattcaagtttttctctttatttttaacttatgtagttaagaatgatggggatgagtgttagagttcttagcagagcttggaaatacaaaatatgattcaactctaaaactagaattgaagtaggagaggatatgtttcaggaggcagaatctgaaacaggtaattatcacaaatgggaaaaaagaggaggataaaaactggtattatcagtaaaatgtagacacggtaacaacctgcccctaactataggtcatcaaccccttgaagtaagagattttagatcccaaaaaaagcctcttaatggcagacactctgatgcactgctgcgtcttcttcagatatggaggatttagtcgccaagtttgccagcaaacaccggtgaagagtcacctttctcaatctcatgttccattctggtattgtttacctccaatgatgcatcgatatgaggctctgaagacctagaccttttccccaacttcaggtgcaagaccatgccagcttcagagctccctctgaggtttgctgaggttttcactgagactgtatcacattccaacttctccccagcccaattctgcttccatttcttccctttgcttccacaggtgttgataccaagagctctccttaacaaaagtcctctatgctgtctttatcccagggtctgccttcccaggagcccaatctgcaacaagacaaataatgcctaacaatggattaatgatgtctactattctgcaacttacatctcatttctttctaatgcattggaccagagaaatttaaaactcaaatgaactgtaaagtttccacactgacactgttgggctaatagtattcccatgtgcaaggcatgcatcttttcttccccagagcaatgcctctcatgagagagctaatggtattgcaatcagctgctgattgttttctctgttcccattttctgggtgaaggaagaaagagcaaaaaagtgtgtgcttgtgagagaggagggatggtagataggcagaggcaggctcagaatggaaggaccacgtatcttggaatattactaagtcaggacttgagtgaaaaaagactaaaggtaagcaaattataaaaggatttaggaaacgcagtccggtattggatattgcttaaagaaaattcccttataagtttatacttccaagactctgaattggattactgcaaacatcattaagtgtttctaatttaatcccatgagagtaatggaatccttgctctgagacatgcactcttactttttcaggatgatttaccagactagaacctcctgatttccccttttttgtgtgtgcgaatgaacccctgataaaatcttgtggctgtaacatgctccttaaaatgctgatatgatagatttatttttaacaataggctatagattagctgttaggaagcaaatagattattacaacaggattaaagcaactaagagtgctagagataaaagtctcccaaataattggaaagataaaagaaatatcttaaaaaacagagctacatcacactgatattgtaaattcaaaatgggtaatgaagctcaaagcctccaaagcttgcagcaagtgctggtgaattgcttgggaagatgcaactagtgtaatcttttacctttgggtcaatgttctgattcttttgcagcttctgctcacaagactgagcttgcttgatggtatcgggaaagatatgaacattttgcgtgtgcctccacatgcagccaccacagtgtccgtggaagatagcttttatgaacttcatttacagaggaggaaatggaggctcaacaagtttaggaaattattagggtagcaaaactagtgggtagcagagtgggattcaaatcccagtccctgtgatacaataagccacgctctgtagggtgctactgactggagaagctcattgctaagaccggccatgtgctccactgacggcactatctttgtcagagacgttggaagacaggcaaaattcaagggcatgattctactgggaaagttgtcagaatcaaaatggagtcatttgtgttaaaaaccctgacaaatagagccggagaaggacatgaagggagcagtcacgtaggcaaatgcctgattacaagaactatcacaaaagtctgtgaaaaccgcagctttgcatgaagactattgcagccttacatgcacgaaaatagttctgcaaggacatatgcccagcaacttcctgtccacccttggactggcaccatcctttctattgatccttgtagccaaggatagtgatctcaaatcagttgtgtacctaacgtttcctgtcttcctagtgataaaacatagtttcctatatcgtgtgtattcccattgcaacacttatttccaaataaatattttcttttagagtctccatgtttgttatttaggtcaacactgcaaagaggtgtgcgtgtgtgtgtgtgtgtgtgtgtgtgtgtgagtgttgtgtttaatgggtaccaagtctatgctaatagatgatttctgtgaagcttctgggacagagctgctgctaaggcagtggtttgtcccatccttctggtgtaggcactgagtgacccagacaacagtcattccgcatgtgcacacaggagcactttacttgaagtccagaaccctacagcagtttcagccttttcactcagaagcggtgggaccatgagcacatggcttggcaattctgagtggtggttgaagagtgtaaactatggaggcaggttggctgggctgagatccaatcgctgccactcactgactatgtgacgtcaaacaaatggcttagcttctctgtgctttagttctcatctacttaatgggtatagcattatggcctcatcacaaagaattatcatgaaaaatctgtgaaatgatacatataaagcacttaaaaccatgtgtggcacattactgtataactagctctttaagagttaactatttttaatatctgggctcttggtaacaataaatgagctatttctaaattgtaaaagacagagaatatacacattatggtatatagtcaagttgtgcaattaagctaaacatatttgaattgtacaaatataaatgtaactctacaaatatgtcatatgtacctgctaagcccaagtcttaattgttttcctctagtcactttcccatagtatttccagttctttgcagctaaaactcagggttagagacttcttgcatctatgggggccagggcaatgcactaaatgtttgtctgcttttggggtgccactgaatgtgaattcctagagaatatggatgatatcaggttatcactaaactggaagtatttctggtggggttggaaatgagagaagggttctcttcgttagctgagtttatttaactttagcaaataacaaatatagacactgggaatgaatgagaccctgaaagtaggagttgaataaagtcatgcaaatatttgtacacgtttatttatgcctgcaggaaacaagctaaacaaatccaagagcagctgaaagtgccacaaaatggtaaaagctacagtctcaaagcatccagcacaatggcaaagtcagagaacttggtgaagagccatgtccagctgcaaaatgtaagtgacatgtctacacacctcctcctatagcctacctcagtgcttccagctcagaggtgttgggagcctgggatcagacttgtaaatatttttcagagctttatagggttttgcttaaatcgttttaacagttctgggctgggacgtatgcacacatgcatgtatgtatgcatcagataaaaggcaagttaaatttcagctcttgattacaatctgtaatataaactaatctctagtaaaaataagagcttcagttttttgtcccatgaacacttgttgaatccttagtttgtgccagaagttgtatgtgacaccaaggatacaatgtcccttgccataagggaagttctatgtaggaagaaacacaaaaacccccagaatcagaagaagtgagttccgagatagttgttgttgcagcagaggttggacaagaggaagccagtgggaggtggatgggggtagacttgggggctgcctcacaacagagtcggactcggactgggtttggaaggatatgaaaagttctatagagagtcaaagggctaagagctagaagccagaacatgcaggaagaataaagccatggaatcctaaaaatgcatgttatgttcagagaactccaagttaaggggtgtgagaagaatcaaaggtgaaaggtggagtttcataatcaatccttctaattccaagccttacagagatatcagaacttgaagttaaatgcaaactctttgcctcttacactttttgtaaggcagttttaaccattactgaggtatattgcaaaacactaaattaaagcaagagaattctgtgtaatacatgcagatatattcctcttaggttagcaattctttgaccccacacagcatccgcactttcagaatctgaggcataaaacaaaagaacaaaggccattgcataaacctagcatttgagtataataggcaatcatccaggacacattcacacccctccaaatgcttcaatcactggaaatttatacatcactggtgattctaagaaatcattacccaaaaagtcgctattatgatgtccataacagatgtactcagatgatttaatgcagaattcataaatcagagtctcttcccaggcaagttttgttaaacttctattcatggcaatgtgcaggaattgttcatttcagaaacagagtgaatggttttgctattgatttctaatgggtataatcccaccactctaaaacaaccacagtgatggagggcttcattccttagcaactggttatgtcaaagataaacaaagccagacactagttaaagtgatgaggatagattctaatcagtaacatgttagtggaatagttgaactgaacttctatttgtacggaaatggctggatttttttttttttttttttgagaaagaaagaagtaaaattatatttgtttgtaaatgacatgatcttctgtgtagaaaatgtcaggcttctgagcccaagctaagccatcatatcccctgtgacctgcacgtgcacatccagatggccggttcctgccttttctgatgacattccaccacaaatgaagtgaaaatggcctgttcctgccttaactgatgacattctaccacaaaagaagtgaaaatggccggtccttgccttaactggtgacattaccttgtgaaattccttctcctggctcatcctggctcaaaaagctcccccactgagcaccttgtgacccccacccctgcccaccagagaacaacctgctttgactgtaattttcctttacctacccaaactttataaaacggccccacccctatctcccttcactaactctctttttggactcagaccgcctgcacccaggtgaaataaacagccttgttgctcacacaaagcctgtttggtggtctcttcacacagacgcaagtgaaagaaaatcccaagagtcaaccaaaatactgctggaattaataaacacattcagtggatttgcagaatacaatatcagcaccaaaagttagttgaatttccatacattaacaataaacaattttaaaagaaaattaagaaaacacttccatttgctagagaacttaatgtaagaaacgcttaggtataaacgtaataaggtgaaaagtttgtaccttgaaatctacaaacattgatcaaaatgattaaaatcaatagacatacaacccatattgatggattggaaaaattaatattgttaaatgatgatataacccaaaatgtggtttaaattcaacacaatacccataaaaatctctatcagtttttgttaaagaaacaaattaatataaatgcattgtctcatttagttctaacaattaatttatacccacaatgtgcagaaaatagaaatgggatttggagcttgagaaaggtatgtctgtcagacagctagtaagtagctgaaagacaaaccaacatccttataactcagtggttctcaacagaaggcaatttgcccaccatcccttgacatttggcaaagtctgaagacactttggctattgcatgctgggagaagaatgctacaggcatctagtgggtagcggtcattggcgctgatgaacatccttcaatgcacaataacctccctcaacagaagattatccttcccaaaatgtcaaaagtggtaaagaagttcacagtccatgctcaagtttcaaatgggaccatggggaagttctgaacaccaagttccatcaccaagcttcccaccgcaggcatttatttccactttacagagggtgacgggttattcaggcatatttcatccttggaaaggaaaatttcctacttgcttaccatatcaggcaaatctgtctttgttttatcttgaagctcatgttaactacttgaaattctttgcaaattgcagtgtttaacaaatgaattgtctggctctggcattcctttattaagttcattaaacattcatggaaatgggtttcactttatagtcatctaacaagatgcaaaacacctcgtcaagtgaagcaacatgatactctggaaacacttgactccaaggctgcagaactggagtagattaccctccctgagaagcatctagtccctaccattgttttaaaaacaaataaagcatctgtgagtaaagatgaactcacctcctttgctgtgtctcaagtaagaaagagctaaggatagaattataacctctagaaccttcaaggcaaaggagtgaaacttctcagcctggtttagggatcagaaaagaaagtcatcaaaagagatcatccgttcttctctcttaaaatcaagagaaaatattcacaattgaaaaatgaaagaagaaaattgtatacccttcataccttttttttcagtaatcattttaagaaaggtaagtttatgggggaggtaacattaaatgagaaagaactggaagataatacttgcatgctaaagaggaataataagaatttaatgcctaggccaggcgcagtggctcacgcctgtaatcccagcactttgggaggccaaagcaggtggatcacctgaggtcgggagttcaagaccaccctggccaacatggtgaaaccccatctctactgaaaatacagaaattagccaggcgtggtggtgggtgcctgtaattccagctactcgggaggttgaggtgggagaattgcttgaacccgggaggcagaggttgcagtgacccgataccatgccactgcactccagcctgggcgacagagtgagactcagcctcaaaacaaacaaacaaaaaaaacaaaaccaaaaaagaatttagtgcctaacagagccttaaaaattggtgaaaaggcacatatttatccagtaatgtttattgaactctggtaaagcccacacttctctgtgttgggtactgcagggatagcttagaatacaaacagaagaagtggttcctgatctcaggatgttcaaaggttagtggagagaaaaatgtacaagcatataatatctttattatatagatacattaaatcaaagtactatcagagaatggaaaacgacttctgaatttgactaggggaatctcaagcctacctaaaggaggtcacatgtgaattgagttgttggcctaaaggaaaacaaacaaaggaaacaaaaaacctaggcaaacttaatataaatagagcaattattttggccagttttgaggactgcaacctgagagcatagacttaatgtaccctaaatacatgctcccatcagcagcagttacaagtgggtttttataggaaatgaagaggcagttcccaaattgtttatcaagaatttgcattaggccgggcgcggtggctcacgcctgtaatcccagcactttgggaggccgaggcgggtggatcacgaggtcaggagatcgagacaatcctggctaacacggtgaaaccccgtctctactaaaagttcaaaatattagcctggcgcggtggctgacgcctgtagtcccagctacttgggaggctgaggcgggagaattacgtgaacccaggaggcagagcttgcagtgagccgagatggctccactgcactccagcctgggtgacagagcgagacaacgtctcaaaaaaaaataaaaaagaatttgcgttaaaatagtataagctattgcttggcttatccatggttctttttattacaaattccaaaaacttgaaaataagtgatgaggcagttaggaacaaaatgtctttaaacaatcacccctgggtttggtgggggtgagtgactacaatcccacactctgtctctctgggcctgataaattttgcatacctcatatagctcacactgctctgagctatttttggtagagttttgagagtgaattgaaaatcatggaattgtttgcagggagtaggtcagaagaggtaattttgttgtagcattaattaaagttaatttttaatagttctagcctaaacgctgatttattgctttaaatatcaaattataacttattgattgaatatagattcatacattcatttatttacttaaatatagactaaagagcctactaagtaccagacaatacctattaaggaacaggcatgtgatgatgacaaaaaatgagaaagctgcttctttcaagaagtttgctgattactgcgagtgatcaatataaatcaaataatctcacaaatgtgggctctcatctgtgccaaggcctacaggaaatagtgaacggtgctatcagagcttatagtaggcaggctggggagttcatatcagaccaagaatagctcagctctctaaaaaggtgcagttaacacatgaagaatccccctggtgaagtggtaatttgctggggaggaggtggcgttttgtgctgtgcctagtgtctgaagagggtctcttttcatattattttgctttaaaggaaatgtgtgaaaattgcaattcttaaagttcttgctgctttggtgtccatgcaaaaattctcaacagcggtcgagttgtttttaattacctacattagaaatcccagtgaaatcactcttgaaaacatattgtaactatcaatttccccatactcgggctcataagtcagagtggcaataaagaaaattttgtcacagacatatttgaaccaagcaatgcagagagaaagacatttaaaactgcctaaaaatatcctcctcctgcttttattgcctagggttccagaccaggcgattatcagcactgtcaacattgctgtccaaaactgaccctactttcatttaaccttctgactcctgctgtgtgcatgtggcagacctggaaacaatgctgttattctactgccaacatgcgcctgcttcatttgactggcctattgatttcggtgcaccacctacaatgtgctaggagcaaagcaggtgggcgggcaagaggagataccttcattacctgggagcatttgcattagccggcactttcaggggggccagttggatgaatgcttctcctaggaaataacaatattaaccagggcctatgaaggagttaacaacaacaacaaaaaacacttgagctaatgctgagagcaccattgaatgaactggggcatctccttattcactgctaacaggatcttttgtatattataccaaatgagctcttaaccatgtgcacacaataaagtcaggatctgtgtcaaggaaataacatagaatcaactgccaggctttgtaacattgtagaggatgctaatagggagatccagacaggcagctaatctgagcacttaaatttcactgaagatacaatcttaagaataagtttgtccagaccttagcttgtctcggagatagaactgcatgcatttggatggaaacaaaataaatatttttgggctgggcactgtggttcacacgtatgatcccagcactttggaaggcaaaggcagatggaccacttgaagtcaagagtttgagaccagcctgcccaacatggtgaaaccttgaccctactaaaaatccaaaaattagccgggcgtggtggtgggcgcctgtaatcccacctactcaggaggctgacacatgagaattgcttgaacctaggaggccgaggttgcagtgagccgagatcaagacactgcactccagcctgggcaacagagtaagactctgtctctctctctttatatatatatatattagcacagagcataaaatgtccaaaagctatgatcatggtcagtcaggctaactttccaggagggttggtataggtgaactgttttgctgagtggagtatgcatcttgagggcctacacctgagctactcaagcaattaagggaagactgaattctgcctttagtctctcaattctttttgtttatttcgatgtgtacttttttaatcatttatgttattttctattttcttaagcagatctgatattttaggatagctttcaatttacagaaaagttgagaggataccacagcaagtttctatactctgtattcagtttcccctattattaaccttgtatattagtagggcacaattctgaaactaacaaactaataagaatgcattattatccataaaatcccacatgttggcattctcacaattgctattgtttattctgattttttgagtgttcacctgattgctgcctgtgttctaatcccaggtaccgcattacatctaatattcatgtctccttaggttccccttacctgtgacagtttgttgattttttctttttatgatgaccatgacagttttgatcagtactggtaaagaattttggaggatgcccctttattggaatttgattcttttcttatgattacatggggtttactggttttctgtagaaatttttaaagtgccatttttattatgtcatatcaagatacacgctacaatatgatttattattattgaagtttaccttatcatctgtctgaggtaatatttgccaagcttctccactgtaaagttacccttttcttctctctccttttgcatagaatactctttggaaggaagtgattatgcatagcccactcttaaggagtggggagttacggtcttctttccttatggttaagtatctacataagttatttgggattctatcacaaaggggttgtctcttctctcccatttacttatttattccatcatatatttttatcagtataaataaactcatggatactattttatactttgatttgtaatctaagtagtaaatactatgttacgttctcatcagttttttctggctttggccattgataggtctttcagctggcttatgtcattttaacattatgtatcaattcactgtaagttttcagggtttttttttgttgttgagcactacaagacactccttgcttatgttgtacattttctgccttggttctagaatcagccatttctccatggaaatagctagtttctttctttgcagaatttcattggagactgagatttggaagctaggtgtgtatgttattgttgctacagggatgtcttttcttggccttctcaacagacagatcaaagattttatatatatatatatgtatatttttaaataatagatatattaaatatgtctacttaagacatatttaaataatacatatattaaaagatatatttatatattgaaggttgcatatagactaacacatatctaaatttttctatgtaagcatctgtatctgtattctgctaaacatgtgtctacattgatgtctacccccaaatctaatccataactacatcaataattctaccctcctcccgttgcttatttataaatttccactccaacagtgaaaaacctccttcccactgtctattattcatttacttattttttcagtgacagaatacacataaagcattctcacaatggttataccatacctttgcactgttcaactttaatggctaggcggtgcatttgggcggtagttttgcctttagtctgctgaacacttgtgaccttcagaagtgtttcttcactttttttcctctcttacgtgagacggaaaggctacagggagcaggaattggggaagtgccttctttctggtgagataaggctctggtaaaatatttttactacaggagtaggcaattgttattgagaatgctctgtgtgcatttcaaaatagttacttttccccttccactggcagagacattagatgattttttttgttgctgttggggttctttgctgtgagaacctggtgtggttcctggaggtcaaacccatggaagtatcggcattctgcctaagactacagaccccaactctcgttctagtgcccatacagattccagcaacttgtccaaattacttcttaaacattcctaccaatttatggttccagcagattcagttgcagaaaagctgatcttagccattattctctgtattcacctgtttctccagatttaaggtggcagtgtgcccttcaacctcaattatccaatgaatacaagaagacattttcagtttgttcatttatttttcttattgctaggacaggaatagcgacttccaaactcttagcttgtcaaaactgaaaccacagaagctatctgaattcatgttcaacaaaaatgtatggaatataatttggaagttggtcaaattattagactcttatcatgcttccacaagtttcaagcaacctccggataggaataccagcaatttaaacttgaatttcaggtacaagtagtcactgaaacaaaatgctgtgagagaaagaaaaaaagttctaaaataataaattctggaaacacatttatattaatggaccaaaataatacaaataaaaacaactgtttaatatcgcaataattcaaacatatgaaataacagatttaggaaatatctatcatgaacactatgaataaacagaacaggttaagaggttaattctgtttatgagtgttatccggaattttggacaaggccctctatctctcagattctaagcagagactatgaactaatggtacaaaagatgaattaggctttttgacaaggaaggaagggaggaagggaggcagggagggagggaggcagggagggaggaagggaattactgacttttagtgatttggcagtttctctaaaagatctgcatgctccagaaatagttggctgatattgtcccctggcagcccgtattagtccattttcacacgctgataaagacctacccaagactggatgatttatgaagaaaaagaggtttaatggactcacagtttcatatggctggtgaggcctcataatcatggtggaaggtggaaagcacgtcttacgtggcagcagacacaagagaagagagagccaagtgaaaggttttcccttataaaactatcagatctcatgagacttattcactaccatgagaacagtatggaggaaactgccgccatgattcaattatctcccaccaggtccctcccacaacacgtgggagttatgggagctacaattcaagatgcaatttgggtggggacacagccaaaccatatcacagctctctgcagttgctgaacatacttgctttcttcagtttgtcatggatttgcccagagcatctcacttgtttttgtagctgggccttctaggcacctaggtttttcttgtaaaccagtttattagataaaaaaagatatgtcttttatatccctcatatgtcttttatagacctgaaagtcagacagatattcaggatatcatcgcactttaataaacatgtccattcatctgactttttccatgggtactttgcaatacacaatcaataatgaagcacacatagaggtatttccattatgtattggatctttgttatttgaggttgttgaaaacaatcaccttttccaaattatctctgtaccttctctttgttctctgtcattttcctccattttgcaaaaagactgaccagcctttataggtccactgtgaaaaattcggattctggttcaagacatggtcattactgccactatgtggcttgttttggaagttattgaaaataaaacatttaattggagcttttgaacttaaagctgcaaaaccttgatatgttccctagtctccatagcttatactcatggatatactttttcccaagcataacacctaattagatagttaataatttcttttaacttaaaaatctgcctcctaagtaattgcgtgagaaacacacacatgcaaatgcacacagaaaaatatatgtacatacaaaatctgtatatatataaacaccaggctaattatgtgtatataaacataaatatatacacaatctatttatatctattaattgcaccttccttatttacacaaatggatttatatgcatacgcttttgcgccttttattcttttcaatggctgtgtagtattcatttatggacatttctattgttttgagtttttttcacttttgtgtttatttccgtttcgttatggacaattgtgctgctgatgtaccctggaaattattattttgaacttttgcaattatggaaatttgcatgatagaaattctaaaagtaatattttggatcaaagagtatgtatatctaaaattttgaaacatattgtcaatttgctcttcaagttagcaccacggctacttttccagggccttttcctttatcagatattcttgaaatttaaatttctctatttattttaaaggcagagtcttgttatgttgcccagcctggagtgcaatagctaatcacatagcacactacagtctctaactcctgggctcaaatgaccctcccacctccacttcccaagtagctgggactacagctgtgcaccactgcacttagcttaatttcctctattctgattaccacctctttataatgagtgcagttgcactctttgccatatgtatgttgcctgtctttatttttctgtgaaattcttgttcacctgttgcctttcatttttttccagttgatttctgcctttatatcttaagaatagtctttaacataagaatagcctatgtttccccaggcttttacttatattttgatttactaataatcatttttgttacttaagacatttaaattagtagtaaatcaaattttacatatttttttctttatggtctctaggtgttttgtcctggtaacaaatgtctttctcccataaggttaggaatacatctcccatatagttttataaaggtttttgaatgtatttccattatccaaagagttcattcatatcttcttgtgttagtctgtttgccttgttataaagcaatgctgaggctggttaatttataaagaggtttatttggctcacagttctgtaggctgtacaagaagcatggtgccaacatctgcttctggtgagcatttcaggaggcttctgctcatggcggaagggaaaggggagcaggtgtcacatggtgagagagaaaaaagagaaaggcgaagggtgccatgctcttttaaataactagttcttccatgaattaatagaatgagaactcactcattactgcagggaggatacaaaccattcatgaagaatcaacccccatgacccagacacctcccaccaggcctcatctccaaaattggggatgaaatttcaacacgagattcaaaggggacaaatatccaaactatatcacttctctttatcaaaatctaaaaatataaattgaactaaaattatactttactgttatccatagttatgttccttgccacaattcataggtaattaagttatgacaatgttaatggtttataattttcgtgactagttgagaaagccgttcttttttttttttttttttgatacagagttttactctcttacccaggctggagtacagtggcaccatctcggctcactgcaacctcaatctcccgggttcaagctattctcctgcctcagcctcctgagtagctgggattacaggcgcatgccaccatgcccagctaatttttgtacttttagtagagacagggtttcaccatgtttgccaggctggtctcaaacttctgacctcaggtgatctgcctgcctcagcttcccaaaattctgggattacagtcgtgagccaccgtgcctagcctgagaaagcctttcatagtgaagctttgttgttaggtagataaaaatttatgaatatttatcacttggtagattgctcattctatgaatatgaaatatccatctttcttccttttaaaatgcattttatacataattatattttatttgaaattattactgttaaaagctttttcacctgtacattgcagggtatatctttaccaattctgtcgacttttttctctgttgtttttaaattagctctttcagaacatagaagaccagatattcagtgtatgaatctgtcttttaatagttaaatctaaccatccacagtttttatcatcactgatagtttcacacttattcctgtcacatttatttccaatttaccatgctctcttgttacaaacccccttattaatttttgttgaattaatattagtttagttttttcatgtattgtatattacacaattcttatattctagtgctgtctaatttctaatacttaaatatatatattttgttcatcagtgtctaaaattaatcagcatgcatatattacattgtctttattctcaacaatcccagctaggattttttgtttttaaatgttcattcttctctctttttatgttctttttcttatcaatatcttccagccatgttgaaattctttggactttactttcaagcattaattttaaagccgacattttaagaaagagcttacaataaaatatcttccactccttcctcctggattcatttttcttcggttagaactatttctttctccatttcttacttcataagtcatctttagaatctatgtaaatataagactacaagcagccactaccaattgattagaaatggtacttagggtggaatttatctttagttttttatagttcagagataacatttctaaaaggctaggaaacatcttagagtatcatcttaattattgtatctaccttctttttacctggatcaagtgcattaagtattgtctgtgaattttttcaacaaccctataagagagattttattatctcaccatatagatgtgagattcaaaaaggttgattaacttgattttttttatcagtgcttctaatactggcttctttgcttttgaaatgagaaaaaaaaaggtatactgagttttagagttttacagttactcaggttaacacttaaaatctgtagcttgacacattgggtactgaatatccagattcaaaactctcttttattttgattagcatccttaaacttctatttctaaagaaagtcttcacctggagtttctagaagagaactcttctaccttttgccacctgttccagcgcccagtgtgcagggagtgttaaagttgacaacttattggctcttgagatgccatgtgatatttcttttggggtaaaatttttctgaagttgtcatctacataagccttctttaggcttctatatcttataagctattatagtcaaaggagaaaccaagagttctgaactataaggagtgaaatgctcacaaattctcttgttaaacatggtaactacctggtaacaagctgaaagagaaaaacagtggaatgtggtggccagatattctgaaccaatgtctttcatcattctcagaatgttatgaaatttaataagtgttgattcaatccttattattagtaacccagctagtaattcaatttttttggtaagatgtacatcaactaaaacatacttgtaagtgccttttggctgtcagtcatagtgtgccatgggtgtgcattaattaaaatgagatagcaggcttgggatgctgacatgaagaaccctcttcaatggatcctgactaggcacagagatggttggggcaggggaggtgaatactcaatgtattggaaacaggacacaaattatgtcttatctcctgctcctctagtcaggtgaccaggaggaactggcattccagtaacttctcaatgcttagctctggtgttataggccctccataatgtatccttcgtctcaactctgtacgtgtgatttcccacagtattcaaaggtggaaaggcatcctgtgactgcattggagaaaatgatggagtcaagttttgtcggcccccagtcattccctgaggtcccttctcctgacagaggaagccagtctgtcaaacaccacaggtacaagtagctcatcatggtgggtgtgggcaccttcacactgtgtgtatgctgggtggcacatgccaaggactggcagcatgacttaggagagacaactgttcttgcttctcctgtagttctctgtggagtaaatgctcaaacacctcacatcaggtaaagcaaagataccagtttccacagcagacagcattgcctctgtaagaaacctgatagaactatagataacacccatcaaagttacagaccagtaaaaaaaaaaaatgcattctgaaaaactattttaaaaaatatgttatctagcctgccttttctagattacacagttaatgagtaattcttccctatgcagcctaatgtgacagacttcaggttttccaatatggttcttacaaaataaaattttccacggggaagaagcctggtgaatcttcttcttgggtctataaaatcttctgttataaatgaggtggcagtttcttgcaagcttcccagaaattggctgctttggagaaaaagccaaaaacatagttatttgacacatttcatagcattctaaagcttaacttgtccttcagcatcttctagtccacacttttctgttatcaggattctgaaactccaaatattaaaggtatttgttctaaaccaaatgatgaagtttatgactaatgctagattgtgttcagatatacatcctcaatctttatggaagttgtccgaagacttaagcttccttttcttagtgaaatgtacaatattttacaatttgaaaaaattatgaaaaattaaacattttaacaatgaaaaagtaaataacagttgttcccagcaatgaaagttgaatgttgttgcccctttgttttcacatgctgggcaatagtttgcacaacaccaagccagaaacatacatgatagaagaaaactactttctccttcaccttttaatgagttacatgaagaggattttattgtttctggccacacttactttgagatttttagtcactcttgacactaatcctcagcacttcatggtaatttttattctcattctacatgagtagagactagaacactgagagtttgccatttaaaagaatatggtatgagtctatgttcaattcaggattgaaatatgtttggctcttggataattgctttagctattcttactgcaagttttgatttatatcaatgttgcatttacagaatattttcctgtgaaaagagcatttcatttcactggacctaatggaagttttcttaattagggaaataagtccaatattaccagtcttttcgaagacagatattttctcccaaatggtattttctcctcctgattatgacacgttaaagtagtattccacctagtcaagtaattcagtataatatcattctagtattatatgaactgtattctgtcataaatgttttaaaattgatatatatgttttaaaacatcagctcttaatatgtttgagctgcaatattcctatccccagttctcgtgtgcttttatgctccctcctaaacttggcttctcctatggtgtctaggagtcactcacagattaaataaggacatctttaagagaccttcctttttgtttggatcaatgacattgcagtatctgttggcatacactgtgtcctgatagatgggcaagcgttgacttacaaaatgcttttagaactttgtaaattatagtttaatatatcatagcttttgttttgtaaaacatgcaatagacttgaacgttttcatgatcgataacccaggcactgatttatatatcctgcaaactgcaccataacttcctgaatgccactgagttagaaggcctgaatagctgattgatcaataggcataaaactctttttaagacaggtcactagttcatactgatatactttgttgttatgacagtttagcgaactatgaataattaatttcttttgtgcactgcaaatatgactcatttggataactcatatatgaaacagagctattaattcaaagccattatttctaatgtttagttcgaaaaaatcccatctgtttagaaaataaatctattacggcatgtcatatttattgcattatattttggcaatataagtcacttatctttttttattattttatttttttggagatagagtctcgctctgtcacccaggctggagtgcagtggtgtgatcttggctcactgcaacctccagctcctgagttcaagggattctcttgcctcagccgtctgagtagctgggactacaggcacatgctaccatgccgggctaatttttatatttttagtagagacggggtttcaccatgttggccaggctggtcttgaagtcctgacctcaggtgatccgcccgcctcagcctccgaaagtgctgggattacaggtgtgagccactgtgccccaccatgccacttataaaaagcatgtatgtaggttttttgcattgaaataattccagggttttcagtgacagagaggaccctttgaattgccagctgtggcaggggagatagaggaactcatcgtgctgagcacctattgtgtgccaggctccatgccccatgctttgcatacttcctctctttaaacctccacatcccatagtgaacctaggaaaattcttaagtagaatgctgatatcttccttttgtcactcccttctcactctagcagctagtttctaccttttttgttttctgccttgccctgtacaccaagagggctgcaggctcttatgtcctctggtttctgtgggttcagtgtaaggcacaggcatgagatagacggcagggaggacagtgaggtcatggcacttgtgtccccttcctccctgcttggttgccttccttatatcccttttctggggccatggagcctgcagtgcggccccctccttacaactcactttctctctgcattctgggaactgctccctctccttgtcccttaagtcagagggataataacagcttcccatagtagtcctggggcacagcagtctcatttattgctttttttgccctcgaacacttatcacacttttgtatatagcaaaatctctaacaatgaaccaggttaaagtgccatctatgtctctccaggactctgactggtacaagtacctccatcagcatcatgcttccagtaactagttacctgcagacctgagacttatactcagttgcagccaactctagcatccaaggcttcaggccccgcagaccccatcattgccattggatggtagataaaagtaggaaggcaaggaagcaaattagctgttagagagcttctccaacttgtgggcttagtgagctatctagacatcccttgttaggcatttggggacacaccatataatgaatgaaggtataggggctaggcacagtggctcaaacctgtaatcccagcactttgggaggcctaggtgggtggatcacctgaggtcaggagtttgagaccagcctggccaacatggtgaaacctcatctctactaaaaatacaaaaattagcctgccattgtggggggcacctgtagtcccagctacttgggaggctggggcaggcgaatcacttgaacctgggaggtagaggttgcagtgagccaagatcgtgccactgcacttcagcctgggtgactctgtctcaaaaaaaaaaaaaaaaaaaggaatgaaaggaatgaaggtataacaatgaatgttgccagatatgatctcctgcttgcacacatttaggaagttaatgttggcttgaggaatataaagtttgatcagtcaccgtgccacaaccaagaaagtggttactaacactcaaataccagattttcaaactctaaccttaaataatatttgtaaagtcctgttttgtattgactaagtagaattaacagtaatatttatggaagaaaagtgacataaccccaaataatatagtaatatgggtaaaatgtctttgagagactggtttctttagaaccttgataaatttattgaaattttgagaatgttttcatctttctttctatggttgtattgatatttacagagttaaatgagaatggagcacagaattctcagttcctttattatttgagcactgcagaaccagtgtgaccacataaactagcatctcgtggaatgtctacacatgagcaaagttctcctcaccagtctacagtagggtcaattcagtggggtggagatgggaatggatatggaacaggtaatgagtctcatcagcaatggatttttatagagtctagttcttttctgtgcataatctatgtaggaattctcagtttgttaaggcctgtggtataacccacttacatgttttgctcattgatggcatctataaacatatagttatttaggcatttggatgtatgagtcaaataaaatatataatcagatgtttattaaaagcaaactcagaagaaaaataatttagtttgtcaagattgattaaaatctgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaacttccctttttctcagtgtctccaaaggtaaaatggattgggctattcctgatctcattctaccacatatacttcattcagggatggccctggcctagaactttgagaatttggggtgcagattcagtgtttgcaaagcttgagcagccacctgtgaggttattgctatgatgtcttttgtttgtttgtttgtctgttttcattccaccccagcaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtaggtcttaaaacagcagtggaatttagggagggtgtctttaatgccatagctttaagttaagttttaagttccttggggttttattcattgatttattcattaactggctatatatgcttactgccatctttgttctacaaaaggtgaaccaactttgatgtatagttgtgatggaaaataggtatcagggaaacattagattagaaagaaatataactaggaagaaagtaagtgtagctctctaggcaatatgttattagatcatttgctaatacaactggaaatttgtctttgatttaaaaaatcaaaggaggattaaagtgttccttcatctgcagattagaaaaaggaccgaattctctgataagtattgtgaacaatacgctaaacaataactcatggcatacgtacagtatctgcttcccctgagcttgaatgtagaatttgggtcaatgttgagagtgtaaagtcaaagtacaacttactgaactcatatatgcaagttaggggtagacgggtgggctttggacaccattgctgctactctttacagtgcaaaaggtgtcccttcctctggtggacacagatccatagaggcctcaaagcatggtgagctgagtacaggatgaatgttaaccattatccatgtagttggcataaactgcccaactaaacatgcgatccttgcttaaactgactggaattcaaatcccatctctgctccttactactagtgtgactgtgataatattttatgatgtggtcttagatgctcttatctataaattgagaaaaatagaccagacgcactgcctcacacccatagtcccagcactttgggaggctgaggcatgcagatcacttgagctcaggagtttgagaccagcctgggcaacatggcaaaaccccatctctaacaaaaatacaaaaaattagctgggcatggtagtgtgtgcctgtggtcccagctgcttgggaggctgaggtggcaggatcctttgagcctcagaggtggaggctatactgagtgcacatggtgctactggactccaacctgggtgacagagtgagaccctatctcaaaaaagaaaaaaaaaaatacaaataattgagtaaaataatatcaaccccctgaagattgttgggcagatttttaaaaattatgtgtgtaaagagtttgtagtagacacacagtaagcagagaagtggtactggtatttattgtcacagtaattgttataattttttcagcaatttcaagtgcaatgcaatcagggtttactctagaaatttcagaaatcacttccctcactcaagccaggttcttgtggctctgtttttatctctctgaacgagccaagccaggtttctatgctgctttggcctggatgatttttccagactgtctctatcaggctaaagatcaaaacgggttacgtctagcacagagcctcacgtttctcttttcatatgggcatgggatatatggagcagtgtcctgtctaacaaagatcagcaacagatttcttaaggaaaactggaagataggaaataaatggccggtggctaggttttataattttgaagcaattccaaatggactgtaaaaggcatttggtacagatttagggtgacagttgcaaagtaaacataacagccaaggggttcaaaatgtataatgcgagtcaagaagcagtttgcatttctcttggtcttatctgtggaaaagcaggcttgcatttaacccataattataattgatcatgtttcatagtgccttttccatataaataactaatgatgcctcttattagtgaatatgactatatacatatacataaactccctgggatgaatgttacaagaacaagtgagggaaaatcaacttcagagattttgtgagtggacaaaaaacccagctcatgctggccttttttttctattgggcactgttatgaccatctttccatatgttcgattagtaagggtgcttggagcctgtgccaggctcaagcttgaacaatgcacatatcatcaggggctcagagatctcattacatgttcaggcaatgctttgcttttttaacctcctgggagactcacttattttctgcgtggtggtggttttgttttggttcagtcactgttgggttggaatattctctccagttgcctggccacaggtattttcccatgtgtgatatccaccagatgttgataaatggtgactctaaatataagtcactgtatacccagcacaatgaatctcagggagcaatctcattctcagttcttaaaaacagccattttccactccctggggactgactgtctctctggactggaaatgggattcgtaatagaatttcacagctaaaggccgtctttaaatctggccccagcctggaggagggggaaatgaatttgcaagagccatcagccatctgctccttgtttaccaagcaagtgggcgctgtctatgacagttaggcttccaacgtatgtggcttctttccttggcaagaacttcagcccagcttgaacctaacatcgatcttattgtagcctggggaaggagtgaggtggagaggagattcttgaggaaactttgtcatgactggatccctggtcaatgacagccatggtaatggctcacagaatttgaactgtatcatgtcaggaaaatcaagctaatgtattcatatgccagacaaaaagagatggaatcacaaaagttagattcacaccttaaaagcagataaaattcaaaatgtactgaatacctaccacacctagctagcaactttatatacttctcttcagttattctttagaaattttattgataagcacattaaggatatcagagtttaaatggctagcccaaagtgacatacacagtcctgtgtaaaagagctgcgattgaatactggcttttctgactaaataaaccactaaatcaacaaggaatgtgaagaaaaatcacatttatggctgatgatttgtaaacggaatatctaattttatggcttcagagggaagcgtggatgccttcaaaatagtctgttcattcattttcatgtgccctaggaactgagatggtttggagtcgcctagagaaacacaaattccttagcctgactcatgaatgactgggaaccaaaccaagtgactaatagttggaatctttcttctttaaaagaatgcttcgactcacatagttacagacaagatgcatttgtaatttctttgttgaggatgagaggaagactggcccaaagtgaaatgataagctcatggaccgaacttgtggaagcatcattggccctcaagagatacagaactttgaatcctctgactcagaatcacatctagaaatttagctctcacttaaacttctgctggaataccagtggtgagacactcacatcatgtctggggggaagtgaggcttgccactgtgtctctggtagaacagggcagagacattatttcaattagtcctcagaaaaatttcccctccctctgagcaatcaagttagtgttactacctgattgttttaattgatggcaaaattaaagtgaggctgccatttgtctgagattccagagcatatagtaattttggaacttgaaatcatgtctaattcaaaacaaaatcacagttaggaaagttctcattgtttacagctcatcttcatgtcatggtaacattttaaatttcagttgttaccagtcatgtgttcaaagcctgacttgggaattgacatctaatagtccactgcaattcctctttctcatctaaatcctttagtcagtcctctggcatatgagaagaaccctcaaagtttggcgtgaattgcctttgattatgtcttagtcatgccacatagttgacttgttgaatttatattctctaagatatttgcacctttttccaactgtttagacccaagtgtaagaatttttacctgtcaccatcacatatcaacttaccagattctacctgctggtataccctgatgatatttgtgggaaatgctatcctggctacattttttgtctctgtttcactggtgaacctgacaggcagactttctatattttcatacatacaaatcatgctaacaagatggtgctgagagcgaaacaaaagcctgaaattttttctttacttcttgttgaaattgatttattgattagaacttttaggctcatatttttagctcatatattttaggctcatatttctcatataacactaatgagaatggagtaatattccccaagaatttccaaatatgtagctgtgcagtttgtatgaataaagattacataaccccaaaaagcttttctggttccccttaggatagtcgttcattagcaacctctaacattgatagtaattagaataagacaacttgggtttaaattctctgtgtgacacatactaaagatataattttgggaaagtcatttgagtacctcttagtctattttacgcacccattaaatgataataataaataaactacaaggttttttaaaaataaaatgagttaattggagttgaaagtgatttttacaagcactgtacagatgttagctgttgttattaagtctgaaaatagacattaagtaggatataaagggagagtttaccttgaagatttgtttatgtattcatgtgttcactcagttcaagtgtattgattacaaactctgtattaggcacagtaagagaggatgagcctacaaaggcctaaatctcttccctgtttgtgttcactgtctggtggaaagacctctaatttgctcccatcatgtccttacaataaagatttgtatttagtgtgcaacacactgcattgcaattattatctacatgtataaacatgattttcatttacataataatggcagtcgaggaaaggagatttattgtatggaaggttgatatgtttaaattgtgtcaaaatttgaatgtttactgtttaaattagggacaaataactaagaaatagaataaaacactactgttcaagttccaaaaccccatttctataaatctgctgcgtacctgtcccattttctgtcatggaacagcacagaggagacagatttactagccctgcacaggcaagaagggaacttagaagattctgctatattcaaatgacttgtgatggcatattggcattcttgacaagcccttgccatggaccaaagaactaccttacttggtttcttggttacttggttgtaaggaaagatgctagatgggtagaagccctgtggaacccacttcatattcatccccaggcaggtagaggaattgttagcctcccattcccaccggctggctcagcaatctggcagtgaggtggttcctttagagcacagtgccagtggaaattggatttggatcccctaaaatcagtgtgaagcagaaaaactcttgattgtagtacctggatgcttaatattgggcttcttgattggcttcgactagggtggccacaacaagtctactggactaacccagggctgagagggtggtcgagttgatggagtggactaatgccattatgggtgtcctgtttgtcacaatggaaaggccacacttacctgctcaatccccatttactttgtattctaggatagaggtcaggaagactatatcccacctgcctatacagctgtggtgtgttgaaagacccctggacttaaagtaagaagatctgggtttgagtctcagtctgtcacttattttctgtgtgaccttgggcaagtcacttcacctatctgagcttcagtttacttctctgtttaactgggaacctattatccgtctcatggggttgctgtgagaattcagtgagatggtgcatgtgaaaagtgctttgtggattgagtattgctctaacaaagcctggtagaaagcagaaggagtaacactgtgtttctttttcaggtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttagaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtggggtcgtataaaactcttgacactgtctagaccattttctgatgtgaatacttttgagaggatcaactattggctcattaatgatatcagtatcataaggtgagttcatcaaggatgtgtgtttattttgaatcatgcctacttaaattattaatacaagacaattaacaaattgacagttaccatttgctttctcatcatcctcattaccatttattttatagcaagtctgctatgtgtggaccaaggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagcat

SEQ ID NO: 2103 - DNA, 63187 bp, Homo sapiens
gagttgaagctcctctcccttccgaacagctccgcgcaccgccccgcgacgcagcccggcgcaactactttcttctctctcctttctttcttcctctcctttttcccctgctgggtagtggctgcggcggggtgggggagactttgaatgaccgagctcgcgtccacctttctcttcatgtcgacgtccctggaaacggccacacggatgccatggttacttttgccacggtaaggggaggcggcgggcaccttgggtgggcaggtttggggatgggggtccacgtggggagggattttccagtggactggtgcggggggccccagatccgcatcccgccccacccccatcgcgccgcgctcactcactttcccgggcttgtgtcttccccaaagtttgcgctgggatctgctcaggccgaagcgcaaccgcagccaccccgctacacacacacacacacacacacacacacacacacacacacacacacacacagacacggacacccttctccacctcctcccctcttgtccctcggctgcccaagaagcttccctcaatctgggaaagtgatcaggtttaagggacctggattggaaagggtgggggcagaagaggggaaatggggacgacgaaagagcaggaaagagattcaacagaatcaaccacccaccactcccaaccgacccgcctgctcctccgagaaagctcctagcgcatcctataacaaaagggggtggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcgcagatgttggagctccgtacgcagcccgcacatctgggacccctccggggagcggcgggcacccgggcccggccatcccaggggatctccttgcggtatcgtccagcctgttctcggactttgagcggtggcgtgggaggccgggagacctgggcacccgcgcagccagccaggtcggagtttaaaggtcccacgacggaccgaactgtcccattgccccagagctttactcagtggtggatgctcctgatgaaatttgggacgcttgggagttgaaggttagggacaggaggggcgagggccgagggcatgggatgggggagtaggattctgcttgttgctctccgcgggagtgggtgcgcgtccaggaggcgctgcttctttgcgggagtttggctgctgcgttcattcgtcgtctgcgcttcagatgcacggcactgagacccttgcgtccgacggtgtcggggctgtggactagaaaggatcccttttgctggaatcgaggctggggtgggattgccggtgggggaaacaccgaaaagatcgtctggcctcggcctctggcggcgggcggcaggttctgagtccgaatggaggttgctcccgggagcgccgggctcagagctagagagctcgggagactgtgcgcctgtggacttgtttatgtgtgtgaagaggcgggggcgagggcctgctgagaggggaggggagcctggaaggggtgggtgtttctcctggagcctgatgtttgtaactcagctgattatggagtgcactgagcgacctgctttttaaataaagaggtgcccgctcctaccccgcaaaacagcgaacgaggagaacatggaagcgctctgtcctaaacgtcaggatgggagaaagttgtaacatagaggagacttttccagaggtcctgttttcacaacactcagaagttctccagcgtactcagcctgcctcccgcctgccctcaattcctttttgacatgtcacacaaagaaagctgaaaggtagaatgtggaggataaactccaaccccctctgccttgggcgcaaacacacagacttaggtatcgtgttaggaggtaagggggttggaaaataatgcaggctccggtagacagtgttgaagggagatagaaagtctggggtatttcccctagggagagtgtgtgggattttgtgttggtgaggactggagtgtagctggacttagagggtttggttgtgtgtgaatgggatatgcttatctatggagtgagattgtgaccattgagtgagtggtcagggagggatggggatgtttttccaaagtgtgtgtgtgtgtgtgtgtgtgtgtgtgtgtgtaggggaaggtggcaaaagagctggagtcctatccctctttggtgcctgggaggtgtgtgtttctggggagtctgtcggatgggcatctgtgtgcttagcgggagacaagagcttgcaggaacataggtgtagctaatgcgaaatctgtgcctatgaagggtgtcagagcaggaggagaggtgcagcctgttgaagacagatggcttgtgcatgcctgcacaaacacatggagtgggtgtggtgtaggagggcggctgtgtgtgtgagggaaaggtggatgcatgtggaaggttgggcgcctgaggattaccaaagggatgtgtgtggggggtgggggaagattatctgaggagcacggggtttgaacttcatgagggtgcactgggaaatttggctggaatggcactggggcatgtagggggtagaaaagtgtgagctcagatcctctttatggaaagacaaagcatttgcagggaaggacaccgggttggtgttggtgtttgcctcccccctccttcctccccagagagaagagaattggaggaggcttagaatgagggatgtacatttaaggggaaaagtccttgtgcattggcactgggtgggaacaggaagagatgtgtgcataagactgaagtaagtagaggaatgcactatctgtgcctggtgtcagggatgcatgttgtataatgttttgtaatgggtttcttatgtaataggagaattcactatcaccagttcatattgataatcaattaaagctaatggagtgcctactggatgctcagcccattgctgggtactggggcatggcacactgccctggaaaaattccttctccaggctcagtaaaactgatgcaattttgccagaaatagacagagctcgacgcttgttgaggtttcttcaaggtctataattcagtttctagagatgtttatggatcttgggggccaaagggaagctgacttgaaatatatctctggttttgtaaaaagtggggcataaagagagggatgatgtagacttttgtgtattgggaagggagctggacggtgttgttgtttcttgtgtggggtgtgggctgggaattggagggtgctgcacttcaggtcagaatgcaggtccagatccctctaaggattgagtttctaagagtacacagagcctccttcatagctggaatgagacctgttatgtggagctggagaatggtgaagtcatgatcaaggaagagatggactgggagtgtttgttcatctttgatgttttctgggctacgagtgtaaagctaacctgagtgtgtgttgggggggtgggtatgcatgcaggtgcgtgcacatgcactttggcctggagtaacgtaactgggagaaaactagcgaggtggataggaggggtggatattctggctcttgtgaagggggtgccagtatgtgtttttgcaggaattctgtgtgtctggggaaggataaaaattgtcttggatactcagatgtgcatctttagcgaaaaaaggtgtacacaaaagaagggccgtagactttggggaatgagacaaaggtgtcgttgatcgggtccataccctgagatggctggtgaggcaactgggtaggaacagagtgaaggctgtgcttttgtgatgcacacatctgcctgtctggagcagacgatggggatccccatttgattaggttctgaccaccgttgggcatatgtttgggaggactttatttgactcatgacatttttgaattcatgaagttacagctgtgccattttaagggtctaccttatttttgagagggaaactcatctgtgtaagagatagtttatatagggcttgactattggtcagaagatccggggcagatatttctgagagcagggtggtgaagtgcaagactggattgggaatgtcttagttctagtccagttctaccacttgggaaaagtgtgactttggggacatttttaatctctataactcttctgtttctctttttgtaaaggggcaatataatgactcaaggagaaggaaagttcactcctcttttcccccatcaaaacttgatgtgtttagttgtatacagccatacaaagatgaaatgtaattaaatacaggtgctagcacgtatgtaggtcattgtgaaaataggatctggacccctttctctttacaatgcaacttaatcagtaatcatgatgcccacagcatctctactgctcactcattgtgtaaataaaactttttataactgcctcagtttactcatccagaagctggaggcagccaaacctagattatagatgatggaaatctttaagatctttgagctattcagaggaaaggtagtctaagaatcaatgttattaatgatcagagacagacatttctttattttttaacatcagctatgcagaccacagcaccaaaagaaatgtgacgtggagaacagcaaaaataataattgcccttgacataggcaccatttgaataaaagaagagcaaagtctagcctgcctggtaagaggaaagcctgggctttgggtctttgaaattctttgtgcccagtgcagcaagttgggtacagccactttccccagagatgaagatggagtcgtagaggggcatggaaacacactgaaacctccgattcctcccagaagtcagtacatgctgtcaactcctggctcagagtcaggctcccatccttgagttcagtggccataaatagtcaggagctaagctatttccaagaggcactaaactaattctgttgcttttcttggcgagattgggccaattaagttgattggaagaggtcactgctgatgggtctcacattccccaggcgggacaggccagcagagtttaattacataacatttcccatgtcttcacttccactcccagatgtatcagatgttcaggcctctcctctttccctacattcaggatgcctgacggagcaggcggcttctgctacaagcttctccagaccttttcctgagcagttacagcactcccaccccaactggagggaatgcaagtctgtgcattgcctggaagtgagagaggggatgcaggctgacacagaagatctttagagcccaccaccctgcctcaagcctcacccgcggctgttttactctttaacgaggcaggcagtttctggcgttggggatgttgaactaatgaccgttgctagggttttagatttagttttatttaaaaatgagtttgttggaaaaggaccaaatcttctactggagacaagcctaagccccgtgtggtgctgctgataaggtctgtggatgtactttgtgcatggacaggcatgtgtggagtaagaggagagcacaggatgtgcgtgcgtgcgtgctgggggacacgtgagcgtaggagatgccctgggtagatggggcatttgtagagcttatgttatgggtggcaggtatctggatgcttggctcagattggattgtcattggattgcttcttacaggtgggacagcctgagaaaaaagttggggacaccttccttcagatcatttttatatgggcatgttgaaccttgaagtatgaggccagtgtagatattacctcattcttgcctggatggatttctaacaagattgaggctggacaaaaaaaaaaaaagtctttcagaggactcattttagaacctgtgagaacacatgtagatggccccagagcgttaaagtattttttgttgttgttaatagttttccataactcagtcttttgttttacctaaaaatactgagaggctagaggttgcacacacccccacatggtcagaatgcatttgctgttcatgtccccatctgtgccatggtccttctcaaataggattaattgggaactacggagagcttgccgcagctttggttgtcctcacaggacaaacctatgactgaccgtgatgtcattgaaacagaacagattttgacgtgaaatttcgtgtggtctgttgtgattgctcactttttagtaacatctccagagaagacatttgttgagccccatttttttttgtgggtttgttcagtcagagatttgttggaagatttaaggttctccaacattcaaggccagagattttggaggaaacagtagctaacaagagcccaggccagggtgaccttcagtagcctgaggcagcaggtagctgcctgacttagaagtgaaggaccaggttcagtgactgggctctgtcactaattagctgctactgtgtgaccctggacattctctgtaggacatgactttgccatctgtaaatgaagggcttgaattagaagatctcccagtcccattccagccctgtcactgtaggattccacagtagccacatcctcctacctaatcagtgctaattacctcacttggagtgcaccctggcacgcccttaacgagctcctgtttttatctttggggaatggctgagtcaaaggcagaaaagcgtgcaaaaaatttgccagagtgtttccttttggccaagaatgctctaaacattggcttagcctacacagggtgtgcagagctgaaaggggtgggatttggctttctggtaggtctgatgctaatcattcagcttccacgtgaatgtctttcagtggcaatgtctctgactaaggtaagcatccatctttaagatgatggatgatgatgatgatgacagttaatattagagtacttactgggtgccaggcatttttacagctattacatggcattatctcagtactcaaaataatctcatttacagatgggggtactgaggttatgtgaggttaaggggtatgctgatgttcttggctttccagcctgaagtctgtggcatcccaagcccatcacctgctagtcagattctgttttttatgtctgtgatgtcatccagatgggagctgggtccatcttcttctgcaaagttggtcaccccatagggtaacctgctccctgcccccggaagcctccttgtcatgtgcaagacaaatgtttaggttttctagccacctgctggcaagcatgtgtcagatctgtctcagcctccattggccctctccctttacttcttgttctgttgacaagggaacctgcccttacagaatacggatattgatttaagccacaattgcctccttgtaaactctataaaattggagctggacatctggttttgatccacacgcccacgagaggtggtaggtcccagcattcttgagtcctggaattgcacagaatcaaagtgaaaaagaatatgaatggagagcatgaggtatctttagaatttggaagatggctttctttgataggctagggaactcacaccatttagactggggccaaagttaaggtaggtttcttgctgggaggttggggggcaggggtcactgctaaagactgaggtccccaggctgtgtttgatgcagagcagagcagctgtagagccctccagctgaggatttgccactgcacaccattctctgggcagtaccagaaatagagaagccaaacaggttcttggggtggatgttgccctgtttgaagattgtgactaaaggctcattccttcttcctccactgatttcctcaccatcactaccacatatacatcatcaagacagttaaggacaggtgactttgttctgttgcttaaacatatttgcatgtacaaataaatgttgaacactaacctaatgcctattagaccataggtactcaaaaattatgtatttactttgcttaaaataacctttcatgtgtagggtgataatttttttcttcatatggagtatatagccttttaaaaactgatagccaggttcttgcaatttacttcccccttccctctgtttctagatctaagaccccagcatttaaaaatatccttctctggctctaagtgatccctcagggagtttgtttcaagttctcaatctgagattagtttcatcccacatctagaggacctgcttctaatggttcataaggtacttccactgggttcaagaggaagacacagctctagaaatcacctgctttcccaacaggtgtgtcccatggtggggaagaagcccagtcctcctaacacccacctggctaccttaaatagcttgccacagtctccctgcagagagcccagactagctgtgtgactttaagcaaatcactttccctccgtgggcctcttttcctggaaaagggaggagttggactcactagagggtcacaaggaccctaccagtgtgacagatcacatcttccatgactccgctgctccctcggccccacactgtggcccatgcctgggattttcaggtaaccctgctggcctagaggacttacatagagtgatttggagggggtggaggaggaaattaagttatgtgatgccagataagtcattgaacatacggatgagtgcatgtttatgaagcactgaagaaacaagcttgccagattcgtggcggatcttggattggaagttgggagtatgcgagaggtttatgtgggattaaagttgtctgtgggtagctgaattcaataagctaaatcagagagatcccaaactctgcagagagatcagaccccgcctctaactccaacagaggctaattacaattttgggaagtcctcgaaccacactaggtctcacttcctcatctattaagagctactgactttgattatctctaaggtctttcttgacttatcattaattaaattgtgagaattgggagctagtagaaaaatctggacaaatgcgtggatggagaaggggatacctcaaatggcctaaatatagagggaaatgttctgtacaagtgatacgtttattcttgaatcggagatagcattggaggatatattctgtacaaatattgtgcttcaaatgcttacccctccatcatcatcaatgatattaaaatcattgcttaacctgggatatttgcttaacctgggaagcctccctgcatttccccagagagcctaaggctcccttcccagcctcctgatgccacttagcagcctgtgtttaatttgcattcctagaatgtgacttcacagagaaagggatctgttgttttcatttttgtgtcccccaccttgaatagcgacagccacaggaatgtgttgagtgaatgaatgcgtgaccagccattgtgagctcagaatgtgcagcagcgatttgacagtgccaggaacttggctcagagaggcagtgcaccttgccagggcttcaaaacagtgttacctttatcccccttttggcctgtcccaaggctaaggtcatgaatgctcagcgcttggtggccagaaaaggctgttcttactcccttttagagacctttcttccccacatcttagcctgcttagttctcctgcaaattggggctcttggtcacagggaatcgggtgtcattgcatacgcattaggataactcctcgttagacactcggaaagcaactcaaaacacacgtgtacagattattcattaagcagtctgttggtggtcacgtgctaaatgttggggaagatgcagagatgaatgtagtgctgctggccttggggtctggaaactggtgaaggaggcagtcaggttacaatcatagtgctccagggagaacaagggaagcaaggaagatggaatacagggttcccacttcaggtgttgttttttagtacaaaccatgattgagaatcctcttggttcaggagcaagctggagggtccaggaatggtctccgcttccacatgacagtggttttcttgtccctgaattcccagggctagggtgatggatgctcagagaccattgtgatgggagcccttggtccttgtggggagagtcgggggaacacgcatgttgtacaggtgttggggcttggggaggtgtaggtgtgcatgctcaccagggtacttctcagaagtatccctgctcgtggcatggtgggggtgagtccacctcaggcccctaagctgtgcttctacttcctttctaattatacagcatgtattgtctctgtgaccacttctgacacaggaacagactgccatctactgtccacttctgtcctgagtccctcctgctcaaggaggcatttattttttctcatcctgtttttaatagatccggacaccaggagaaacagacgtggagtcctatttagtaatttttttagaatttagaagggagccttcaaaaaacatagcacatctgtcagatggtttccgtatctgtttacaaagtattattgtaaggggccactctgctgccactgagtcttgctagccgctgtgcgaggtgccgtgtgggataccaagagatacaaagcaaggccttaccttcaacagccttgcagtctacttgcgaatacagtgtagatttgcagagaagcagactacaggatgtggcagtagatatttggtaagaggcatctgggtggtagggactacagaggttttgggagtttggaggaaggaggagcccttataggctgggggatttgggaaagaccaatatgggtctccttttagcaatcccagtgtttaggaagaggcttctaagagctgcgcgatgttgtgggacaggctatgaactggaaactcaggaacctggagggcctgaggtctagtccagcttctggcagtcctgccctgtgacccagggccttgggttccgcatcctcaaagcaaggctgttggtcttcttgtcatgtaagggcccccccatccccgaccctgcatcatgtaccactcttggatgcagtgggaggtggtttcctggtttccagcttgtcaagagcaatagagtcaattggatcccatgcaggaaggatacctggatgcagggccctgtgctgatgaccccacatgcagcaggagagagagaatttccccaggggagttttgggtgctgttaaaatacaaaggggggaaatgttccatgcaacctctgcatgccactcctctccagagctttcctggactttccttccaaaaatatatgtgcatggtgctttgcgtccaagatagctaccccaaaagaaattgtattagtattctagcattgttcatagctcaaatctaagattccttcacattagaattcattccatgattgtttttatggaggttttctttgagtatttgagacttttggtagctgtggattaaaatgaggaaaagattgttttctatagctcttttactccttgtctctttttctctgtctttcttagcatttaaaccaccaccaaggaaacctccagggtgtttattgcatattcttgccttttgatgtgtgtgtgtgcatgagagagagagaaaaaaaaagaaagggagagaggagaggcgagagagagtacaagagagaaagatattttagactgtggtctattagcatgtctaggaaatcaagttgaatttggattgggttacaggttgagagacctcagctcgtcactgtaatcctctgacatttcccttttactttttggctcttgtctgaatcaagaatacatcttcccgttccctcttccatgtttacatcttcttttggggcagctgtataaagttactgtctgtctacagcaagtctccttaattcttttggggactgctcgacagaggcacagtcaaggatagaaccattagagacggtcagcttttggacaaagacaaaaaaatatgttgaggaataggagaaatgttccaattgtcgattatgtgttttcctgtggtatgctgatgtctgtgactgttgtccacagaaagagagcgtgagcaggggctggggcagagataaaagggagattctccccaaaccaacaaatgtggagagagagcaggagtccccagcaacagatatggagccaaacaaccctgggaagtaactaggaaacttcctggtgacctgagatgtgttttgtaatcactggtgaaagtaggaggagatggggtagaggagagttacaggtagagaagttccgtgggaggagaccccaaggtgagagaaagcagggacttaaagaactgaaagaagcccagggaggggatgaacagagaacatcccatatatcccatatccagtatggtggagaggtgggcgggagccaactgggagcttactttttttttcccaggggcatgggaactatggaaaactctgagggcacaattaagcttttgtttttaaaaagatccctccggctgcagtgtggctctgaataaagagttgttcaatgaagaaaggaatggctgatggttggattgatggaagaattaatgaatgagcaaacgaatgcatgagatgcagagggaacgcagcaagcctgatttgatctctggttactttgaccagtactggctccaggggcgattatctcagcctgggaggccagggagtaatgcattgattagaatgtctctggacacatggattaaaatatctgatattttagggtggttgatagtggggaggacttctgaaactttttccctcttctatgcatttccatcctaatttgatttcattcaggatcaaaaaagaagatggcttttgaaattacatcccagaaaatctgaaactgtggcattgacttgctccagagagggctgcttgcatggaagaccttttcataggctcatcgtggaatagggacagatgataaagtttcttgggcatatgaaggggtcccagatttctggacgtcagatccacccatagatgattccttggattaaatgatgtgtgtgtgtatgtgtgtgtgtgtgtgtgtgtgtgtgtgtgtgtgtgtttaaagttttaaagtctcctgaaaattaccaagtgctactgaacattttttttgtcagtagtggatatctggataatttctttcaaggccacattgcttagcatgtataaggaaagtgtgtgcggcagagacccagatggacagccggcatgccatccagttgcttggggagtgtgaatactccttggcaaagccaaagggagccaaagaggacctctagtgtctttgctctcccatgtcctgactattccaatctcactttgcattttgagatcttttaacttttgctaacagtgattgctcaggatgtcattcaggccaattaaatttgaatgtctagggttgggacagaagctcacgaggtgaatgcaatgtgcagccacgttgagaaccactagctgacactgctaatctactctgctctcctccctgccttttggcggctttgccatgatatctgtcccatcctcacctcagtttgctgagaactcctcacttagttaaggaagttcttctaaggatgttcaactaatatgggctaaggcctcctatcccctaaaaatccagcatttgcctgagaaattggacgctaggaggataagacaggttcttagcagattctgaagcactcaccgtctctcatctgctgaagggtgtattgaggatgaatgatggggaacagcagggagaaagaccagcatccatagggcagtaacagggtgcagacacctatttatatgtgtcatcgtagttcccctgacagctcccagaaccagatattataccaggcagatataccaggcttacaggcacctatttatatgtgtcatctccttagttcccccaacaactcacagaggcagatattataccaggcttgagggcacaacaactcacagaggcagatattataccagacttgagggcacagtttgcataatgcattcataatgcaaagtggtttgtgatcttggaatgatcagacttcctacactggttctccccagtaatttgcatatcagccagataccctcctctagggttagctatgatcagggctgctgatttctggcactgatggctcaatgggaaggaaagcgcctatcccctctgttctgtgggattcagcaatcttgggctggtccttccaggaggcccaacctgaggacatgctttaaccaacaggcctttatattgagaaaatagtagttctcttccttgccatttccctgttaggaagccatggcttgcaggacagccagggagtagaggttcagagaaggaggctaaaaaaatcaagacctgaaaaagttaagtttccaaccatatattcccaaattgtagagtggaccatatggaatcattgcaatccctgggtttctcatttacaacttttgcaaaagatattactatgtatgctgtcaggcatgctggagccggatgtctagcacccattgctaagtgcatgcttcggtaagagctttggacttgggattctccagactgctgagtgacctacgtgtagtttagcaacataatgcttggaatgagccacgccgacctgatgcgagaaccggatggtagccgaagagagcaggccaggtagtgagacaactatgatctgcagaggtgggcagcggggtggagacaggcttcttctgcaccaagtactgctacctgaactgtacatcacagagacaagccctgccgagagcagtggaagcaggaaaacacaggcctatctctgtgtctgtcatgtaagtaagtctctcttggctgtgtgtacctgccaccatcaccccatcccaccccaaatatacagcatcaccttcagctatagcttttggtttttgattaaaggacagtaatatttccaggagggagaagagtgatgaacagaagcatttatgtatggacactgggcaatttattgtttttcaaagtctaatctagaacatgtttgcaagaaagcgtgaattgagtaaaaagtttactatcgtattaaggactgttaggtacaatgactgaaggaggagttaagagtgatccttcaataattcccctgtgggattatgcacatttaaggaaaaatgttcttcaggctatttctgccttagagctaggcatcattacagcgaaatagagaactaacctttaagcaagaggaaccaagttctagttctatttctgtcaatcactgtacgcacaacctctcaaagccttagtttcctctttgcaaagtgggataataaaccctacctacttaacacaatgtggggtttcaggtgagatgatgcataggatcgtgcttggcaagctgtaaatctgtaaattacaaatatatattatggtttcaactggtacattcctaagcgaatagcacattgctctgttgggaagacggctcttctccaagtcaggctgggataatgttccctgacaagacactgccatacctaggtgttccccaaacattgtctctgggaaccttgaggaagcaccataagacatgggaagaaatgttacagcgctggcttgaaagaataacaatgtatcagtctacttatttctgataatgtcatcttgggataagagactcagggtagcttagtgagggacatgggcatgcactgcacagtaaaaatggtgtccaggaaacctgggtttatttcagtatgggttgcccacacttctgccaacccagtcccctacttcgtccccagctgctcttgatgaactctctgcacacacttgcacctgtatctgtgaaacagagctcctcctcttacatgagaatggatctggttgcaaatctaatagattccgctaccacaatgtcccctgccttttttgtttacttcatttatgaaaatacccttgaaacatccatagtcccattttgtagacatggtgctttatgtctttgagattattaaatactcatgctcctttctgattgctgttttcacctcttctttaggcttgggcttttctattggtggaatttgctgttccttttcatggtgctggctttcctgagttgggtggttgctaattcttattgccagtttgtcttctgtgacagattctccgacatgcctcggatgtggcttccgtgcttggctttagctttttatctgggctctcgtgtcctgaatatttaccttctttcaggaatttctcacagcttctagccaatgaaagtcccccttcttattgtcaaacccagacagttataattttattttaaatgtactttttgttacattgttttgggagtagggctggaaggacttgctaatggatgagtggtggaaagtgagagaaagaaagatatgatggaagaaggagcaatcaaagccccagaaggaagctatcgcattgttcttggattcctaagcctgccagaaagagctgacttactttacagtttctgagagaactatgtgtgctattactagaagcacaagagaaagaaaaataggatgttcagcatgcttcatttatctaatgtgaaaaatgaactctgcccagtgacttaatgggcataaactctgtttctaaaaaagccactcattcggcaacgcacttctgagttcttgatatggtaaggtattgtgttctgtgctggacaggaatacaaaaatgcacggttcctcacctccaagaacttatagtacatgtagggaaataagacaacccctattgaatatcactcaagatggaaatgactagggccatggaatgtaacacacagagggtacctggagttcctaagacttctgatggatgattgaggagagccctggatcaggtaagcaatttgaagggatagggatagcacagacagcacaggggtggaaacaagtgtggagtgtcgagagcttgaccagtacgcctgaaagggagggagtgtacacagagcgttaataggagctctgtctcgaggcagcttccctcagcccctcccaggacatcgaggttttgggagaaagagcctattgctcactctcacggctcttctcctttttctctgctttcagtttgttctttgaactttttggaaacttcccctgttctttctttaacactgtgcttcatctcttggggttctacgttttgcaggttgtagtgcttgagatccagccttcccaaatgatttctctgaatttagtatttggtatgggttttgctattttgctgccatcccagccctagcaaagaaacgacttacccggagtatggacagggcttcagagaaaacccctaacattcctgactcccgactttacagagctctgccaaaccttgccttgcgggagtaagaaaagcgctaacaagccatcctctttggtgtcaagtgcagacaaatcacttagcccctctgaggtcctccaacagtaagctactggtttgtgaaaccccaggataatccatctgatttcagtcctgcatttagtcacttagaacattctcgcacatgcatttgctggctcatgtacatacgaatatacacatatccctctttgtgccctttcttagcctctgatgatttcttctcctccaggaggcaggaatccaaggcttataaaccatgacttctgggaagttttttcttctgcttaaccagggtatcattgttttttctgccttcccctggagaatcactggccactgccctagtggttggggcaaggatcagaggtagcttgcattctggggtttgtccccaaagcctcggtgggactctgcattggggtctgtagcctggatccactccagtaccttaactaatctcttgactcccagatggtccaaaatatgtggatttagaagagcaacagacagctgttcctctgggcctctccaagaacacggtttggtgtctagaccaccttagagaaacatggcagaggaaatcatggtggagcagcatggaaacaggtgaaacccagacttagtaccttgttaaattccatcctggagtggagataccagaggagcagatattacctttattaactgatagaaatgtttggggatttctctgacttcttgtagggttggataagccccaaagtgaagagaattttgctccttgttttagccattaggaaactcaagaccctgctacagtgctattggtttaatttttccctatcacattgcctctgcaacttctgaatggttgcagccatttcttaaaatttccctgcattgtcactcagacaacaagaatagatttggccttcttcatctcaaaataatggtcatgattaatagttattggactgggaacagtgctcagccctctgtacgtgatctcaggaatcctcacagtactcaatgaaatagcaattttattatctcatttttgcagacaaagcaacggaaacttccacacattttctacattgcacctaagatcatctgagaaactatgctgtacttgtttttctaatgtatgatctgatttttctattataatgttaattctatgaggacagggctttctgtggccttgcttcattgctgtatctccagcacctggactactgcatggcacctggtagttacttagtaaaggtttttcaaatgactgagtaactcatccaagattaaatgtctaggaagtggtggcaccaagcttaggacgactcttttctgattccagagtccagacagccctaaccactatcccacactaccttcttgtttatttttaaatcattttccttcccttcaatccctctccagtgccttacaccttcttgctgtaatttgaagcatggccacagtaagctacctcaagtttctcatctgtaaaatggggataatataatgaactaccttatgggattgtacccctctgcatggtagcctcatcctactgtgcctcctaaccacggcctttaaatcagcaggtatagttaatatatttagttcttttaatctaatctgaaacacaaagcatttgcttccttaattcaagatttttggctttgcctagactaagcttaaaaccaaagaagtactgcagaactgactgaggctgccagaagtaccacactcttgcacccagccagtgggaagtggaaagataacagctaagcctttggggatccttccagaagtagtgatgacgtacagcattctttctgattatgaagtaaatatctgttctaatgtatgttcaacatagagagttaagaaaatggggaaagaataaagagtaaaacaatgaccagaaataccttcaataccctttgacattctttctctgtgtgtgcatgtgtttgtgtgtctttgtttctgtgtctgtatatgtgtatttcctttatttttgtttttttactttaatgtaatttttagagacaaggtcttactttgtcttgtagactcgcgtgtggtggcgtggcactcatggttcactgcaacctccaattcctgggctcaagcgatcctcttacctcagcctcctgtgtagttaggactgcaggcatgcatcaccattcctggctaatttttcaatttttgtgaagacgggctctcactatgttactcaggatggtctcaaactcctggcccgaagcaatcctatcaccttggcctcccaaagtgctgggattacaggcgtgagcgaccatgcccagctcccttttataaataaggggctcaccatacaatataaccagtttttacctggcattttccagtcattattgcattgtacgtatctccccatgtctttttcttttctttttttttttttttttgttgacggagtctcactctcttgccgggctggaaggcagtggcgcaatctcagctcactgcaacctccgcctcccgggttcaagtgattctcctgcctcagcctcccgagtagctgggactacaggcgcccgccaccacgcccagctaatttttgtatttttagtagagacggggtttcaccatgtcagcccaggaaggtctcgatctcttgacctcgtgatccacccgcctcggcttcccaaagtgctggaattacaggcgtgagccaccgcgcctggccctctccatgtctttaattattcttgcataagatgacttttcactgcataatattccatcacataccactctttaaccattttgcttctggggcacattttccttttggtcacactttttatactacagttgccatccttttacatacatttgaatacacatatctggctattctctcagaatagatttccagacgttacctttccaagcttgaagatgttaacattttaaagaaagatggttattcttgaaagccctgacagctctgagtggggagccggggctgatggttaccacaggatagcggaaaggcacactggctggcctgtgtgtactcacgcatccccccacctagggcagccttgggaagagcactcaggattatgagaaagactgtcgcctcccctttgcttcattagctgatcctctaagcatatgtgctttcttggtctaattttcggattggtcttctcctatattctcttcctactccccaccccgaccttacagctaagtgcacatctcatgtagtgcagtgggaaagaaccgtaaggcagaagccgggctgacttggctgtgaatcccagctccatcacttgctggccaggtgactgagtaagatcgtttacacatccatcatcctcaagtttctcatctgtaaaatggggataataatgtaactgccttatggcattatataaggattgtatgactgaacacatgtagaatgcttagaacaatgcctggcatatatgaagcatttaatacatggtgtattaaattagttttgaaaagaataaattaataacaatgatgaacatttttgatacctattttcctattgttttgactctcaaagccagttgcaagcatatttagcactgtgatgtatgtgtgacttactgcaaagtcttttttccagtccctgataccagctctctcttcaccttcagtgtttcctacccctcctgcctccccttccctaagaatattgctgtttcacagagtgtaggctttcctctggcttccagatctgcccacatatgcacacttctctttcccatccctgttggactctttctccttatcagtttatttgttccagttgggaagaactggaacctggtcggcagcttttccagttggctttatctgtgcgctgcattgtaaaactgttctctcttgcttagaaatctctttgatccatgtttagctgtatttattcttccaacagatgttttgggtagtgagaggattttcttctcgcatttgcctagtctcatgctccttcatgcttcccacttgttcgggatctttttgccagctgaccacagacaggggccatctgtcgtgaaggtctccctggcccagcagaccaggaatggcccagcaaccaagactttctgaagggcttagtgaaggggaggagggaggaagatgttggagaactgtgtagggtagagtttgagtttcccagacacattccaggagctcttttgatccaaggtatacatgatttggcttgtgctctgtggcaggttaacaaaaacacaaccttccattgtctcctgtagacaacagagtgaggcccttgggcatggcaggtagcctaagactacccctgagagttgggaagtgtatgagtctcctggggctgccgtaacaaagcaccacaaattgggtggcttagcacaacagaaatgtattgcctcacagttctggaggccagaagtccaagatcaaggttgcggtcagggccgtgtttcatctgaaggcccagggaagcagctgccccacgccttctcctagcctctggtagcctctggcatttcttggcttatagatgcatctgtcaaatcctgtgtcttcatatggctttctcctttgtctcacactgtctttcctctgtgcatgtctgtgttcagatgtccctttttataaggatgtcaacccaattggattaagttctaccctaatgatctcattttaacttggttacctctgtaaagtccttatttccaaataaggtcatgtgctcaagtactaaggggttaggactccagcatatcttggtggtagacacaattcaacccataatgggaaggaaagatgttgggcacctgtaactcctccaaacacccacagagtgcagggtgagctgtgtgctaacacatagtcagttctctttggggtgaggaggcctaggggcagggcccccatgtggggtctctgtccacaccagcaacaataacaaccagggaggaaagcatctcattttccttggctcagttcagctttttatgtttttagcacaatgcctgctttgctcttccaacaatttgggaatctctgggagctgtgcatggaaagcaaggaggacagcggcgagaaaaagggggagtagatggagggtcttggaaagcagagggcctaggcaggcagagaggacaggaaagtatagcgagcagagcggcaaattggtggggaggtgcagaaggctgcttggcagccaggagttcttgccctggccctgccatgaggctgcatgtctgtggcctaggtatttaccttctccaggcctcagtttctctgtaggcaagattgggaggtggatgggtgctctctaggatcccttcctggccagaataacattctcagcaggagcctaacgtgtggagcaaatgggagcactgggctccggcctcctgcagtgagcacagcccctgttcttgtggaaacatcttccaatagggctgccctgcctacagggtcatgcggcatgcatctgctgcctgcctgcgctcttgaaacagcctccactgctcccctcccagctcctgtctctctgcacacgcaagcgtgctactccttttcatgatccccattagtattctttgacgatggcatacatctgtcttcgatcgttgtcagctctgggaggcttatgccaagcttcttgagcgtaacccatgactgcctgggttaggtgttgtgagctgtccaggaggcaggaggacgatgcatgcaagtcagggcttagggcagaagtgcctgggcctggcctccccttggactccaggagtcctgtcctaacagagcccacagccccctatccatctggcctctgtaacccctccccaacacacacacacacacacacacacacacacacacacacacacacacacacatagcccctgtgattgagggggccccaattcctgttcatatcctccaggatagcccacctgcaccctcgacagtgagagacaaagttctattccctgtttagatgggtgctggggacaatggaaaggaggtgtggctctgagaagttcatgtcttgctcagggcacacagcagctgatcgggaacatgttgctgactccaagatgctgccttgcaagaagctggctctatccttcttttggctgaagtgcctttcatggatggtgagggatgtgcagggagaagtgtcaggagtgagggtcagtggttagaatcaggcagtccacagagtctgagaaagcaagacattctctggcagtctgggggtcatgatcgcccaccccagcccagataaccctcacagctgtgcgggccactagagaaaaaggagggcatgtttggggcaggagaggcaaatgtttgcttatctgtgacttcttcctccaagcatgtccggacctccagtcaatggtgggctgtcagtcgtcagctgaggttgagctttccttagcaggagcactggtcacttgggctgggatggttcttagtggtacaggatgcactgcaagctttaaatgcgagtggcatcatccccttccggtcaccatggcaaccagaaacaccttgacacatttccaaatgccctttagtagggcagtgacagcccttttgagaatcacatagaatcgcattgattgatgagtgaaaaataaatggatggtagcctccttttgtgatttttgcagcggcctttagcttcctttactcaccccagaaatcagtgggaccctgggagctgtgtacccctcagacccagttggaacccagccaagagtacttaatccatccccacttgtggggccaacggcacctaaccacctcaggcacggtggacctggctcctcagagagctctagggacagaggagagaaagggtctgcattctgtttgcagccctgatcgtgagctctgggggtcctcttccacccccacccccacccccagcccctggagcaggtactcggggtcagagctctgctgagggtctggctctgggaggggaggtttgtgtaagattccctcccacggttcagcacagatgggatgacaaggaccaaattctgtttctgggctctgatatttgccaagatttttaccaggcttcctggaatagacagggaagcagagcaagctcccgtaggtcaagtgatttgggcccgagttgacccagagtccctaaatgactgctgtgtagctaccatgagtgtgctgagtggcccataggggcaggtatgagagaggtgctgagggaggcagggggcccgcagaacggcctcccatctccactgcccgtccccaggtccacaggctcacagagcagacacggtctgtgcctgggtttgctcacccacaagaggaagaacataacatctcgctccttttgctgcacaggataaaacgagaacagagaggaaacaggaagtgctttgcattccagaaagagcagcaactgtataaagtcatgcatattaggatttgaggtatgcatggtcagaagttagaaactaaccgaatcttgtcattgccaggaagtttcggggttctgtgactggtggccactgatgttcctgtgttcctccattccagctcctaccttgactgtgtcctcctcttcacacctaacttctttagtgaaggctccatttcctcatttcctgttcaatgcttaaaccccttgcaatctggcttctaccatcgccttatcacagacccttctctggctttgccttgcctggcccttccatgatgtcttctttcttgaaaccctctttccttggtaggataccacggcatcctggtttttgtcctacctctgtggctgtttctgcgtgctttccttagctgacttttgctcctttatctgacctgggctctcctctctccatacactctccatagcctattctaagtgtcccaggtctcttatatcttatctctcaaatgcacaattactttgtgttagctacagacccatatatccagcttccctatagataccccaaatgtctttgtaggctcctaaactcagtgtatgctaagctgaacaggggctccttttgtgccccaaactttcccaactccagtgagtcttctccattgtctttcaccttaataaatggaaccacctgcgactctagtgtgtggtccagagacttggaagtcacctcagcttgtctctctgtcatccgcaggatcgggcagcctccaagtcctcatcattctaactctcataatgcctctggagtttgtccagatctcctcgtcaccactgccgctacgctaatcaaaaccaccattgtctcttgccatcctccatactttgcaaagttaattgggtcatttttctacttgaaatcttataatggctctccagtgcctctgagtccttgttttttcaacactgttcacactctccccacctctctctcactcataccccatgcaccagccatcctgggttttgctgtttttgtttcccagaatgcacaatgcaccttctggcctctgagccacagcacctgggtatttgctcacactactgcagctctcctcttccctgccaccacgcctttcttgcctgactgttagtatgcagcagtggccacttgagcatgaccgcctctgggaggctgtccctagtcctctgtcgcattctggggctccctatcacacactcccattgcatgctgcagcatcctcagcacccagcattccttattgtagttcctgattcaacacctttctcaggagactctggacttcttgaaggcaggaacaattcccacttgttcctagtagcattccaaaccacacgtgacagtgtctggcttataataagcagccaataaaaagttgatgaatgaatgaataagtgaaaacagaaggtgtttgcctgcagaaatctggaataagatcaaagatcagagctgggattaaggaaaaaacttccttggggtggcactatgaattcccagaacaggtgactaaccctcattcactttggcaaatgtttatcccatgccacgcaaccaggcaaaaagttgaatgaggtttaatcccttcccacacggagcttattccttctttggaagtcctttaaacaagctctgaaatgattttggcaggtagacaaactggtcctcatttctctgtgaccagtaagtagggaaagcaagcacacatacacacacacacacacacgtgcacacgcacactgacagacaaccttgctcactcacatgggcatgcccaaacccttcttctattttataggatggtaactcactctttagtttagactcttgacgtgccatggaaaatcccactcgccctagaactgggggccgggcaggtttgactgtaacaacgaagcctggagcttactctttgctgattggctttcctttctgtctccatttttcccctggtgagcactgcagttgtgttcttcctcccaaaggtaatgcctggtttggctcactaaaacctgttctttctgtaccgagagctcatcttctcttcctcttctggattctcaaatgagatgacgtcagaggatggaggccaaccacacccttcctccttgaccctgataaagtttcttggaaaccctatactcagaggcagccaattcttgccagtggaagagtgaaaagagggcttgggaagctcaaggctcagtgtctgtccccaggtcccccagttaaagacacatctgtccttcactctcaaagatgttgccattgctcccctgctagagtgacacactgcactccctccttcccttcacaccccagcaagaggctatttcccaggggtcttataagcagatttcatcttctcttgtgctgttttcttatttcaattatcttcagggaggaacgtgcatattgcgtcattgcctggctgtgaaatttcatttccatttctttacacctgcagttgcaatacgagagagaaaaggccagagcttagcggatgtcctagacgcaggttatcaaggtgctgtggctgtggtttcccggaaaaggccttggtcccagagcacattttatcagcaggaccttcgaggggctgcgttccttcaattgttttctctttggggtctctggtctccagttctttcttctctagcatgtgagatctgtgcttttgattcatgcctttaagtctgacattgaaaaaatatctgatttgccattccagatgctcgtcctcatttgcaaattttcctaaagggccagattgtcctctggccttttcccttttcctggtcccacctcaccaccctcccactggggcttcacagaggcagagctagtctcctttcattttttaaaattaatagtcttcaatttttagaacagttttaagttcacagaaaaattaaccagctattacagagttaccgtataactcctccccctcactccccagttttctccattattagcatgttgcattagtgcagtacatttgttgcagttaataagcaaatattagcccatcattattaactcaagtctatagtttacattaaggtgtattctttgtgttttacagttttatgggttatgacaaatgcataatgttatgtatccaccattatagcatacagaatagtttcactgccctaaaactctcctgtgctccacctgcccatccctcctccctcctctgccaccaatccctggcagccaccagtcttttgactgcctagagtttcgcctttttcagaatatcatagtagttggaataatacagtgcgtagtcttttcagactggctcctttcacttagcaatatgcattttaagtttcttccatggaaactttgctttcatccttttatcaccacaaggccagtcatccaaggaatttctccatctctgtctgttcctttctagttctatgtgtgccactgcttggcatagaataggtatccatttaatgaacattccctttcaccacctgggacaccttcccagggataacaaaaataaaaccagctaggtcaatagcagagcccccatcccagttttaacctcattctcccctctttccacaataaactggatcagaaccagcagctctgtaagactgcatttctttcccttaataccaggccccagagagcatttgattccttggcagagaggtgtaggcttaattaatttttctccttttttctttgaacatcttggaacacacacacacacattcgcatttatgcacaattgggtgtatgagaattttaatggcaggtggtgttagcagttcttttcctcctgatacagatcagggtttttccatctgggccttttagcagggcctatgaatattgactttctaaccacttggatttgggtggagtgtgcagagtgggattgggggggaaggttcaagggagaactatacttatgtataaatcacatgtgaagggagttttgaagtcattattgcttcaggatgtgcgaaccataattattttttaaggtcttgatttgcccaaagagcatttcccagggttgctgctccaagcatgacgtctgtgctgtcaggaggtgcagcatagtctgattcgagtttaatcgctttaaaggaggccctgggtaggatctggtctctaggttctcagctgtggtcagtcctccatgcagcaaaacatccagatgacttagatgattaagacagcagacttaaagtgaagaagagattttttcccttattctttccttttattattagtttttaaatggttggctacatgggctgttggtcattctccatgttctctgtgctctcctcagctctctgctcaaaacaggctgcaccggcctgcctaaaccctgaaagcaacttctcagctgcctactttctgccttttgacccccaagccaatccccatctccttaccaccctcccgccatgtcctcatacacctgcctctccttgacttcattcttcatgctccatcagcaacagccctctgtcaataatgattgtcccagggaagtgtattcaagggtcacataaaatgtgccctctctatgtgttgagaaggttttctgtccccaaaggagctctctggataatgaggaaggttgaactggggcagcctacaggaagaagcccttagaagggaaacctgtggcataaaccatgctgatccacgactcttattttggaatagctatttaaaaagaaatatgaagaactcgtaagacttggaaaagaaaactagagaatgttgaaaatgtccaagggttatgtgtatgatgtgtatggggaaattttaaaagaatgtggtagaaaactgaatttgtggtaaaatgttgtcacaggacggcctgttctttcattgaattatgtcttagtgcagggatgacaaataaatacagcaactgtgctgccattctcacatcttttcctacagtaggcatcactaatcaattacaacattcttttccactgtcatgcctttgcctacagcagacatcactaatcaatcacagcactctctctcattgagtttcaaaggttttttaatcctccacataggtctctaagtagctatataccaattactttgatttagaacttggattaccaatttgccatctctagtttaatgggaagaacattaggattagagtcagaatacctgaattcaagttactgacctactacttaataataattaattttaataattctctaacctcagctttctcctctataataagaaataatgcttaccacagaggctcgaggtaaggattaagtaagataatatataacatgtaagataatttgtgtgatggttcctagaatagtacctggtgcattgtaagcacccagcaagtgatagccaagtatgaatttgcagcggcatggacacatcatgccacaccccagatatggaacaatagttaggattccattcacctttgcttcttttaacatcctcagtgaaggcagatggagaacagctggaccctctaattctacctgactttaacttcacattcttaagatgcttattaaatctctctttcctgaactaatataatgcttccttgttaccctggaaggacagagttaacacccatgtattatgacatgatggatgttctttttgcgcacactgcatgcatagccatgtgccaaggccaggcctgccttagctttttggttctccagagcagcttcactgtgactgaagagagccagggaagacatcttggtagagctctttatatgactcttttcagaatgtttctcactgatggagatgacagaaagctaggatgatttgcaggcaggaggacaggcttctttggaaaaggtttcaccatagattacctcaatccagggttggaagactggaaagtggtctgcagggcatcccaggggatgccttcttcaagacaatattagactagcattggaccctgcctccagactagtaaagggttattttcagagcagcaacaccagagaacatgttttgagcaaatcaaatccttaaaatcatgatttcatacatcctgagatactagtgacttcaaaatgcctttctcaaattatacatatagtgccttctgaatcaactgtcttttttctgtccaacagtataaacataatctctgccctcacacagcttagaaactgtcatgagaggtaaacaaatacacaaatgacaaggtaaaatagaagagctacaaaagagatcatgaaaatatccagggagttcgaaggtggcagataacaaaaggcttcgtggaggaggtagcctttgtggcatttgagatcagtcctgcagcagggttataggtggacaggcagagatggttgggggtgggcggtaggagggacagacagaaggaaccacaagaatgaggatatggagaaaaagaccactgaagggtgcaaattattaaggatggatttatgtaaaggatgtggcctaagaagaaggactcttctttatgatgaaattaggttttagaggcagaagtctggtgcttcccggtactaaaatgaccccagtatggtgtctgcagaatacttagataactgcatagatggttcagccttctttccattataccacactactgggttaccaacttgctgtgtgaccttagataagcaactacctctctctgggcctcagttttcatatctatgaaattaggaggttgaattatgtcttggcataataacgaaataaataagtgatttatttttatttctttgtcattcctctttgaaatgggagtgggaataaagtggtatttgtttccacatgaaaattaaagccagggggccaattctggacttggcttgagctgtgctttgtctgtttttctgcactggcccagtaccctttacactggtgtaactaactccctggaaagggatgcaggtagacagcgtgactgttccttcctatctgagaggccccaacagattctatattgcaggaccaccaacttggaatttcagctcagttcagcaaacacttttgactggttcgtgtgctagacattgtgctgggcttatgtggggtagagatgcctgctaatctaaggctaacaggaagacagggaagtggtttccagacctgatgcttatcagagtcactgtggaagaactttttagaatgcagacagcccccaacttaacagtggttggactttcaatttttcaccttataatggtgcaaaagtgatgggcattcagtatgcttctcaacatacaaagaggttgtgtgaaataaacccatcattaattgaagatactgtcaatcaaaaatgtacttttgacttacagtgttttcaacttaggaggggtcataggttgaggagcatctccacagattcctgagccccatcccttgatgatgatgatccagtgagcctgggtggggcctgagaatctgcatactaactgctgaaggtgagtgtgatgcagggccaagcttcagaacctctgatctagagaagattctgtgtcatcacagctcagggtgaccatgttctctcttacttgcacttacatgaattcatatgaattcagtattacatgagtaaattatgattatatgaatttattgagtatcctatgtgcttgatataggtgtttacatcccagggttggggggtagagatgaagaatataagccggactatgttaagatcttcacttctcagcacctgaacaactggcagcctcattaggaaggcaagtcattcacaggtgaaatgacatcatggtcgtcttcttcattcttctcttcagcatccatttaagactcacattttatcaccagagactgaaaagagccacctaaggcaggcaggtcaggtggtgttatctctttatttccagatgtggaggctgaggctcagagaggtgaatccatatgtccaagctcacatctcccgccctcagtccagggcttctccccacttcatgggagaagcatcctcctccccagagcagtaggttctggagctgggagaggccactgtgggctggattgttggggacagcttcagggagagcccgattcaaggcaatagagaactttggctgcaggccgttgcctagaatagggcagctgacacacctttgatctggaatgattcctgctgctgagaatgaggttttttatatctggattctcaggtagtaacaccacgacaacgtgtgtttgtgttatttcatctgcacagcattcacgtgtagcagagagaaggtagtttattccccagaagtttaccagtgggaaattgaggtcaaaggtaggactttcctaaatgaagagaactactatttattggatgcctcccatctgccaagcagtgtgcacagcaggcatatatcatgaaatgcctcatttattcctcataactgtagcctgattttacattcggcaaacctgaggcttacagaaatcatgtggctcgcactcagactgctgatggccacgcaaggctttcagcttctctgatttccaggcccccatccccaccacactgtgctgtccagctcacctggtggaactggatcctttgagttccaggccagggatcctactgagctcttccatcagggaaaccatagcagtagcagctccaccaaggacttggcatctatcttactgcagcatccgtgcctgtctaatggaaccatgtaccaggagtagctacccaagaaacatttccaccagaaacttctctttatagctccccatcgagcctcagagagctgataggaattgctcaagaccacccaacttgtaagtggtagagctgggactaaaaggcaagtcccccaactttcagcctcactcgtgcccaatgtgtctcagcctccctgaagaatatcagaccaagatggccagaaaaggaacctggaagggacgtgtgggcgtcatgcagcccttggcacagtcttcaggctgagctgcctccaccttgtcatctcatcagagctttacatccatccttgggagaggccagctccatgacctctcagtgtcatttaggatcttcttcctaaacggctaacccaagtctgtccgctgcatcctacagtgagatgcactgtggcgagagcagctattggcattctgcttacgtgctgtttccagaggtaaactcagtataaatggatctacagcctgtcccattttgtacagtcgagttctaaaaccagcctgcaaggataatgctataaaaatgtcctgccagccccaagggtgtcttctacaacaagttcttgttccctcataattcttctgacaaattcttcttttgatccagactttcctagccatcatttcattccagaagtggcatgtgtgtgcaaacactcatgcttgagggcgggacaagcaaagggataagaggggaaatgggaactcgaaatctgctcaaatgtggtaaagaaatatatccagaaagtactgcctactcaccaaaatactatttgctttttatattctttcctgagtagaatttcctgttcaaacttgaaaatgaaaattcctccacttcaaaatgaacaggcaagaaatgctgtaggctgggtttcccggggaggggggactgacagccatctgccctgagactgactgtcaaatctgaactctgtgtacttgttagtgttgtttatgggaggggtgagggaagggaggaagcaacagggacctgctaaccctatgaattctccctcatacccttaaaaagtcgggtgcttggccgggtgcagtggctcacgcctgtaattccaacacttgggaggccagggcggttggatcacaaggtcaggagttcaagaccagcctggccaagatggtgaaaccccgtctctactaaaaatacaaaaattagccaggcgtactggcaggcgccggtaatcccagctactcgggaggctgaggcagagaattgcttgaacccaggaagtgaaggttgcaatgagccgagatcatgccactgcactccaacctgtgcaacagagcgagactccgtctcaaaaaaaaaaaaaaaaaaaaaaaaaaaaaaaaaaagtcgggggcttgccaagctcgctttttggggcaatgggagggaaattttaagagctgatttctgtgatctttatcagacctcttcttctgtcctgcccacaggtcagtgatgggaatgatagtattgcattaaaagagaagtgattccccagatgtggacatctcagtgcctgggaggcagacgtctttagagtgcttggtgttcctccccatatctaacttacctgttcttaggacatattcccttgagtgtcttttattatttcgttgattgattaagggttacaaatttgttacaaaagcagcagaaattttgaaagataaaacaggtagaaactgttatttaattggaggcacaaaagccagttccagcttgagcattaactggctgtgtggcttgggcagctcccctgcacttttgggaccatggtttcttcagctctaaagtgaaagctgagagttcctctgaatgctaaaatcttgcttctctgtgattattgttttttaaatgccgccgtcatttcaaaacacatacatggggcagccctcctcagctgcctgtcctgttctcttccctccttccctttgtgccatcagcgtctcccctggatttatcgtgctgtactccttggacacccttgaaagtggagagagaataattctcattccctttccccaaactctgtcctgaagcaccactccccacctccctaccatgcctgcccctccaccccccacattttccctctgatgagatttcctctctgagggaatattttggtcctgttctctgttcccaaacaaattccccaggtcctttaaatctggtttcaatcaacataatcacagtctcttcgatgctatcaactctgccttgatttggttgtgtgattcatgctgtgtcctccacctcctcaggctgttttatatatacacacttaagtgctcatatatatgtgtatatattacacaggttgtatgtatatgatgtattgaaagagagagatgttttccaccgtgcctgtaattactttttatcttcctccaaatcagtatcttaatgcatatcacctaaactggattcattttgagaacactagggccttttttttacttttcaagaacagctatctaattctgggccaaaaactagttatcaaatgagggcaggtaatggagttgtatccagcgagggggcatttgcttctccatatgatacactcctcaccagtaccaaggcgttttctcttcagtcttcatgcctatgctgttacgagtcctttctcctatttgaaagaaaagatatgaggcagcccagggaaagctctgatggaggctataaagacaatatggatgtaaactaaaaaatggtagcttagagcttaatggtagcctctcaggacactcaccacacctgaattctaccagcctgacgccaatgctgctccgcttatgctgggatgtagtgacacaggacactctgctgggggatagggatgatctccccccaccaagtgggtcatcaacactcatcactcagaggggaggtgggataccaccttgaacagagaaagcggctgggcatggtggctcacacctgtagtcccagcaccttgggagcccgaggcaggtggatcgctttagcccaggagtaagagaccagcctgggcaacatggcaaaaccccatcttcattaaaaatagaaacattagcctggcttggggttgcacacctatagtcccagctactggggaggctgaggtgggaggatcgcttgagcctagggggtcgaggctgcagtgagccatgattgtgccattgaactcctgcctaggagacagagtgagatcctgtctcaaaaaaaaaaagaggaagaagttgctgaatccgtcttataaatctgtaacagaaaattatggcaagttgtggcttttaattgccagagctgggcacttaagagagaaaagggtttttgtgaattccaaaaatgtaattgtattcattgaacactgaagtcaggagaagtcagaccataatgacatgggagccattttcgcaaccagcagactagaaggggagggtttggaagggtggcggcagagcttagacacctgctgcgaagggagagaagtggggacagaaagatggcctgtgtagagtcccatgagaaagacagaactgcactggcaggcatctttaggggcccaggtcacaatcatggggccggtggacagtctccagggcactgtgattgtcacagtgcacagcctaatggggaaaattgcacagcttcacttaaatataggtgacatatggacgtaagaattcatgattaatctagaactaaccctgaccagcaaggccgaatgaagaaaaaatgtagaaacactgaccaaaccttcctcaaaggtcacagatcttagggaatgtgtctctctttcacatttcaaaataacaacaatttttgaaatatgtattttttaacatttaattgttttatttggggataattttagactcatggcatccactgtttttttagttacccacatatttgattcagtaagattccctgtattgatacaaaaaaagaagagggaccctgtttccctttgacactgttactttttcctgagctcattgtttgtttgtattttgttttgttttggtttggtttttgagatgtagtcttgctctgtcacccaggctagagtgcaatggcgcgatctcagctcactgcaagctccgcctcccgggttcactccattctcctacctcagcctcctgagtagctgggactacaggtgcccgccaccatgcctggctaattttttgtatttttagtagagatggggattcacggtgttagccatgatggtcttgatctcctgacctcgtgatccacccgcctcggcctcccaaagtgctgggattacaggcgtgagccactgcgctcggcctcctgagctcattttaagagagacttctggcctagaggtttgaatgagaagaagttatacagctgggattcttccctttctctgatatgaggacaggagttctctctcatctccgccaagagcaggaagctggagtaactgccacaagctccaggagggagtgtctagaacatccacgttttgcagcaggaaaacaccccctcacgctgaagtttgattcctgaatcctgtgtcgcagtctaaatgctgaggcagaaggggacatccgtgttcctggggcattccacttgcagtcctggctgtaacccgagtgagccatccgtgtagttcctgttgctaagtctcccctgccacctcttcttcccatggctgcagggcagggggccatgccctcctcttcatttcctgtccctgggtgagcgtgccccctgccttctcccagatctctgctgtggcagcttcacgtgggattcagcactgtgtctccttcccctctgctcggcctgcccatacctgtccagcagagctgtaagaccagaagacagagcattccccttatctatgaagtcaaatgcatgtgtggaacatgccacccagcctgcagtctctctactataaaatactgctcataagacaaatgtgtggcccagatgatttctgataaagtctattattttgaaatacatatgtatgtctctcagccactgatacacgcagaagctgcacatgttgtcaacacctgctttgagctcctttccttcccacccttccttttggcaatgcaagtttccattcattttctgcattactggtctcctctcttctcccctactactagatcttacaataaacatttgaaatagtttatttgtccacagtgtgatttctgttgagaaacatgggctcaccgacttttgggtctcttctaacactagaaattcctctggttttttagactatttcaagggctattaatgtggaacagacggcctttagaaacagcaatccacagggggcccggagacctggattcatatttctcctagcgtcaactagtgggtgaccttagaaatgtcattttccttgtcgggctttagttcccttatctgtcacacagaagcactgtgtgagtttgggaaaccaatactatgttgaaatgtacaaaataatcttaaagcacagatattctgttccctccaagaatacatcaaacaaaggaactgacattgcaagaagattttgaggagatggctggatgcactggagcagggattgctgagggaagccaggccctcacctggagcgtctcaggagaggcagcttcggtgctggctgtttattgcaggcatctctttctgtgtctgtgcgtttaggggctcttctttggagataagaaaagggttctggatggagggcagtgaagaacagtgagaacttaacatgaggatgtttgtatagaggggaagacttctggacagtggcttgactttgctcactgggcatttccttctggatctctgtagaagtcagggacagatctcctcgtgcatatctgtctcccagagacagatctcttcctagcagaaagtagaaagtgggcttcaggcatcctggaagttttctttcttggtgggtgataaaagggcttgcagagagaggagaatcaaatctcccacatgtgcatcatgcctgcgagtctcatgcagagatgtcttatgttcaacatagaaagcaagcctggcagccccaagaccttcctctgcacaccgtccatttttacttggtttcattttgataactgtgcggtctgaggtcctggccaagaaagcatcacctggcaagaagtgtatttggccaatggtaaggttaccatctctgtgtaattaggctccgtaaagctttgtttttaaatttattaatgggaatgatttgacattcctacacactgacattaccctcatggaatggataagaatctcaaggcttgttgggtgaaagaagggcagtgtttggtgtgacgggaagggaaagtataagcaggcagctcgtgcgcatgagcatttgggaaacagaacagaaatcatagaatggcaggcttaattctagctctgtcacctactggctgtttgtcattagaaaaattatttacccttcgtgagattcagtttccttacatttaaaataaagaaaatattcgtcctcatattgaaatgaattgggctatcatgatcaactttaaaatacaacgaacagtataaatgtcaggaattatatgacattcgggacctccactgccaccctcactttctccctccagtggtcacttactctctgtccctctttctgggtcagagcttctgttactccagcctgggcctgccttaagtggggacatgtgctgatccctcacaatgccgggtgacaaggagggttttcaaggctggcttgactgccactgctggtctctcttctcatttgcaactgtcttctccccgctgggctcagtgttcctgggagggtgatgctgagggagaaagctgtggcagagggacgtggcagggtcagagaccactgattcgcaggagctggcctcagagctagcctttttgcattgatctagggaaccagtgatcatagatatctatgttgacgcctgtgtcaatttatccctagagccattattcagtgaatttcctaaggggaaaacaattctccagcattatttttctttgggccaggagagcactttctctgagttttactggcaagctagatatattcttgaaaggctccagcagcagagttcccgtcttgtttagttcaaaaacagctcctggcccgtctctaaatggtcttgctaaaaacatctcctcccacccatagacctgaacttaagcctcagactgctatcctctctttctgccactgtgagagacctatgcctcttttctcattggcttttgcctgcccagccctcctcagatccttgtacatccctaggaagtacattctttccactccacacacataattgtgcaacttgtgctaggaccgcatgaggcactggagctgcagatagcaaggaaatgtgggccctgccctcaggaacttgaaatccggtagttacctagagctacactgagttccctgacgtggtaggaagccctcccagagccttgtccgtgcttagacgttgccttcacagaggtggctaaggggcattttgtccctgccctagtttttacaagtcccctggatgttaactcctacttgcttttatttgcaggttctccagtcttatgcattctctcttattcctaaaaatttccaatccagtgctgatagtatgttagagctgtagggccaggaaaccctgctgggggaatcatcgtctagtaggtggagtgtgagagagaggagactcaggccagaggggcttctgagttctgggcaagtcccttaccatcctagtgcagctatccttctccatgtcctactgagctgccttccttcttgcttctcattcccaaagagaggcaaccatgccattctgggcagtgggcaagggctgctggaattgagatttttatttttctctttggcatctgaatccttcctttgcagttgctgacatgcagttttgtgtgagatcacccatgtcatccatcatcttcaggacacccagaaactcctcctacctctctcagcctcacatgcgcatcttcagtccccttctgattcaccctagttggtctattgctcttggctctgaataaatacctttaaagggtacaggtatccatatggaaggccttcagagaagagagagcatggaatttattttccaaagtgggacactcgagagtgaaagggtgagctgacaataatgatggcaggacaaaagcatatttcaggcttcttaagagcttcatccctttgatccagtgactttatttctaggaatcttttatggagtacctaccatgagccaggcaccattgcaggtgctaaggatatcaaaacacatcaaaagagagcatacagttaagtggagcagacaggcaagaaaaaggatggttgtaaaagaatgcggtaagtgctgagaagtctttctcagagacgtgatgtatgagcaggctcagacagtcaaatagtagttagccagggaaggaaagggagaaattgccttcctggcacagggagttgtcaggggagccctggcagaggtgagagtatacatggtgtgtttggaaaacccaggtccctcgctgaggctgctgtgcacagggagaggagggctggcaagagatgaggctggcaagtgaggcacccaggagccagacgatgaagggcagacaatgctgaggaattttagcttgatcttggaggttatagagaagaacagaaatttctccagctgaggaatgacccaattccattccagtgcggggaagaaatgatagggaaggctgggagagggcaaaatagggtctcggaaaccatttaagagtctattgaagtaatccaggcgaaagaggtagcatggactgtagagaaaaggagggtggattttgagaaataggaggaggcagagtcaactggaattattaaagatcagttcaatgtgggggcagggaagaaaggaagaaagaggactcaaacatgatttctggtgctgccttttcccaagagagaaaatccgagaggctggaggaggagcagggtttgggggaggatggtgacttcagctttggatatagcacccttgagattcctctgcagttcaggtggagatgtctagtaggccatggatgtcccatggatgtctatgggtttggagtataggacggaggtctgtgcctggagatgtgagcatagacgtatctacacatcagcagggttgatgagattgcacagtcatatcctcagatgagaagggaaagcagaatgttggagaagaatatggaaagaatgcaagggaagtgctggtggtggtaggaggaagaccaagagaggtgccgtctggaggagggatcggagtgtccagtgattcagagagcatgagggaggaggggctgtggcacacctgcctgactttgaaatgaagaatggtattctaggtggggctgtttttttagggacctggtgcaggtggggatgatggacatagggaattctactctctgggagacagcatgtggctgggatcagatagttacaaagttatatgacaactattttatttcatttctctaatactggcaacatctgaacattatctacagaggaaggaaaacctttatggaggggtaggttgaaaatatgtctgggccaggcatggtggctcacacctgtaatcccagcactttgggaggctatggtgggaggattgcttgagcccaggagtttgagaccagcctgtgcaacatggcaaaaccccatctctacaaaaaatacaaaaaaatagctgggcttgtggtgcattcctgtagtcctagctacttggaaggctgaggtgggaggcatcacctgagcccaagaggtcggggctgcagtgagctgtgattatgcccctgcactctagactgagtgacagaatgagactctgcctcaaaaaagaaaaaagaagaaagagagagagagagagagagagaaggaaagaaagaaagaaaaagagaaagaaagaaagaaagagagaaagagagaaaaagaaagagaaaagagaagaaaagacaagacaagaaaagaaaagagaaaatacacctgggatggaggccctgatggaagaaggtttctgaggaaatgggtgtgggtcccagagtgtcagtatagggcctgttggagagcgagtatgataaggtcagccctgccactcagaagaaattctggttatactcacagtaatcacacttcctggttgacccagggcagtcctaccgtgcaaccattaccccaacaaaattattgcttacaccccttttcacttttgaaagtttaggtgataaagtatctggtctcctcagagtatacatctaaggagattcgtaggtggagttagacagctgagggagctcctacctgaaggactctgtgcagcaggaggcaggattctctgtatgatgttccaagaggcttgaggagataggagcagctgtgaggggagggaagacctgaaatgagaaaaagagcaaattgttgatctacagtaagggctgagcagagcagatccttgagaacatcaatttgctgggcaccaagtagttcataggccgcgtttccctgtctttagcagcctgcgtgtctgctgggagaatagatgtataaactgatctgaggttggagctgcacagggcagatgtggccagagggtaaggaagtggctggagtggtggatcatgagaatagcacacccgtagtaagctctgcacatggagatacttattgcagcactgtttatgggagcagaggattcaaaatagtaaatgtccaacaagggggtgtcatccggtaaattatggcaaattaacgtgatagaatattatgtggccatcaagattttgtttaggtagaattgtaatataaggagagaaagcctagattgtaatagtaagtgaaataagaaagttccagaatgatgtatattaaaccatcccgcctataatgcatagagatttttttatttatttttaaaaggttgggcacaaatattccataataatacctgtgggagctgatagatgatatatttttgtatttttaaatttttcttcaataagttcattatattacttttataataaggaaaaaacatctctctaggaaaaattatttaaggaaaaaataaacatgaaaaagggtgtctgtaatcacagtttaatttggccttctcagaaaaccattgtagggagtttttattctctagtttccccagggtggggaagatgagcagcatggccctagtgtttgagaacgtgggttttgatatcagacatgcctgggtttgaatcccagctccgctaagctgagctatagtattgccatggtgtgatctcaagcaggctatccttatttatgaagtggaataatacacatccccagtctcttctttataattccgaaacccaaaaagccctgaaaacccagagtcgtttcttaaagtgacagcaaattcatttggctataaaacctaacctgaattgagctagtctttatttcacttcagtgaatataattttgcagtggaaatattaacatgtttaatcattggatgttcgcccagatctcacggagggtatgagataatacgcagggttcaggtaagttgtgaactacaggatctgcgtcatagggttattgtagaatgaagtcaggttgtgattgcagggttcttagcacagttcttgccagagagtaagtactgacaaagtgagttatcatcactattgatgctataattattcgtgagccttcactaagtatggagtgcatgatttctgcttgcccctcttccctccatttccttctttattgggatgtttgagaagattaatgtatcacatataatgagaatttaggatggcattgtttaggacacaggactgcaaaaaagggaagttccagcacagatattttcctgcctcttttcttattccagatttctcactttctggggaattagctgtaggatataatgcacattaacaggacacccaaatacttgaagagctaatggagaagtaacccttactcccttggtgactgctttcgtctcaaagcacatgtgttcattataaaatgttaatgtatttacaccatagttgctgtacatttaaaggtttactgtgctttaagctaaaactagctggatatcaaatgtgcttttaattgaaaagtggttatttactgctttccataggaatccacaataagattttttcattgcaaaccctcctagtatctttaaaatgcaattcagttcacaaacattgatttgcattcaacgtttttcagaagcctaaatagagtgcaaaatgaggtccacctgcaagactacagttattacttcctcctttttcttggaagcatccatgcattgtaaattctgtttgtgtggcatcagccaactacattattaacatcaccaggaggaattaaaatgtatcatgttataggatcaaaagtttcacattctgaatcaatgccagtataaaaagaatgtccagacccttccgtctgactacagtcggcagggatccccgccccagcagccatgtgactcacttcgcattgtggtgagggtcactcatggctcatacgggcctgcggcccgataggcctccccatggggcagcatttagccttttcaaaatcagcttaggatcacagaccctcaggtcttgaaggaactttttggagtttcctctattaaacccagttttaatctggtcatttagactgcatgtctagaaacactacagcatttttagtagtaaactgaaataaatcttcaaataaacgactttaacattttgcacattggtccaggggcagaagagctcgtctgttgccttttaggagggctctaatctttttctgtttcagctcatcgggtcctcattgtcccctactgtatgtgcccagcacaatgtcagggcacatttctacacaatgttggattccagctgatcctccgtgttaatccattcgttagtgccaaattgcagggttccttgccaagcccgtcagcacaatcagagcttctgaagtcaggtacctcaattacattagttcagttgtctcattagcccccatgcatcatccaaactcatcatcaaacgtgttttccttcattattgttgtcattttcttaataccagtcttgttgaaaaaggattgttttagatacaattttgcctaacttgtttcatctccagaatacaatcctaaatagagccaagatttgccggagagaggagatagcggttgaggctggtgaagcttccctccggttagaattagagagaagtggatgcagaacttgggccagtaatggacccatccatctccctagtcaagaggacattcttgcagccagaggtggttccgctttggaaatgatctactttgtgtaaaccggtgcatcacagatactgttagagtatctcacagatactgatacagcatggtctgcattttgtagatatgagggctctcccttaggtttacagccggataaaggagctccacttacctggtgatcacaggcatgtggtccaccctgctgggctctaggactttgaacatagagaaggctatcttttaggaagactgcaggatcaggagtcgggaagcagggattctgcttgtagttttacatctagcagtaacaacttttagcccatccctcacctactctgtgccctggatttcttggctttaacatagcaaaagcctctctttatagttttcctaactccatctctccccaaaaagctggagatgtaagttttaaattccagtccttggcacatagtaggtgctcaatctctcatccttctgtccctcaagatagccgatggctcagccatatatgttccagacaggtctctctgtgtcttttgggaaagccttgttgctctcagactggcctctaggcctcatgttttcccacttgctcttgccttcagtgttaggtcatgggcttgcctcattacctgtttcaaggaggcctctatttgatccctggagcatccctgggagtctgaggcctttaaggactcctgtggtctcaaggaaaaagaactataagtagttctcaggctcccttgatcaattcaaagtcatcttcagctcttccagtgcagcccctccagagctgttgaacgccacctttttcctctttcgggaaacccacaaaaccttgcatggggttgtgctctgtatggttttccagcatcaaattcactcatcaaaagatgcatcaggagggtggagggggtggcgcctggggtgagggtcaaacaaggaaggccagaatgcctgtttgcattcgcaacgggaacattggaagttcgggtggaaaaacaatcccaccggcctttatttaccacagtgggtagcctcgggaggagggggagctgggtgggaaaggaagacaatagaatgctgtgttgccttgctgtaaaagcttgctctaagcaaataaagtggcaagctcagtcagagccctgctcaattagccccagtgcttaaaggagggtctccctgcagctgttggcggcgggcgggctggagcaaaggcaggcgcactctggggcactcgggaggcgaaccggcaggaatcttgcatgggagctgacccgggagggagaccaaaggaccctccaacctgatcccagtccctgcttcttgaacagagggctacagaaggggttggtggggccactctggggagaggcagtgtggggagaccacggaggaggtgaccagaaaagtgagtgcaaacgtttcatgccgagagtgaccgacatatggaacgtgttatccggaagggttacaggctggaggagctcctagagtttttcagggggtggggtgggggagggggaagccttcagaaactcaaggaggtttctaaacaaaaggaatttgagaagggttggagaaataatgagaaatgcaaacttgacccagagtttctccttccatctcacggcttctcccctgcctgtcctcacatgtttccagttcatggggacccaggaaggccactggagccctgtgcctgactccacgtgcacctcactgggggtgtgggtggcggggtagggaggacccgcagagctggctcgctgctctgtgctgaaagggacccagagagcgagagccctgcctggctttagacccctgtggactagcaggctgctagcgccgggatggtctctggatgatttactccggttcctgcccttgctggaggagcaatttgatgccggactgggagtgaaaaacagacttgcccagggactcacagtggccaaaggggaggctgggagtagacgcaggctcttgatcccttctgctttttggcatctccccttctcagcatcccttgcccagcacaccacgcacacatgtacatacacacgcagacacacacaccaaacagatgcacacagaataacaacaccacacctacatgcacacatacacagacatacatgcagcacagacacacacagaataacaccacacatacatgcacaccacagatacacagaataccacacacacatgcacacacacagacacattcacagaatacatatatgcacacacacacatacatacatgcaccacacagaataacaccacacacacatacagacacacagacatacacatacatgcacacatacagatatactcacagaatacacacatgcacacacatgtatagacatacaccacacaagcagaataacaccacacgcacacaccacacacacacacagaataacaccacacacatatgcacaccatacagagacacactcacacctagacatatacaccacactcatacagagacacatgcacacacatgcatactacacacatgcacatgcacacacaaaaacatacacagacatcacacatgcatacatatacacaacacacagacacacccacgggcttacacagacaccacacacacgtagatatgcacacagcacacacacacacagagaaacagacacactcgcaggcatacatgcatgcatacacacactacacacagacacactcgcaggcatacatgcatgcatacacacactacacacagacacatctgcagtcatacacaggcactacatacatagagacatacaatgcacactcacacacagacacacatagacacatgttgtgtgctcatgcgtacacgagcgcgcacacacacacactgcctgacttgtttcccacaagacgggtactggcctgtcgcttgtagccctcctgtcccagcctgtgttggccagggtgccaggcactgccacccctcttgggacaaggtacaggtggccagtgtgatcacggcctgttctgagagcctcttcctgagccaggaagcgctgtgtgatactgagtgcccgtgccttcgtctttcccatggtgctgggtcttggccacctgctgcattgatagcacccgcatgttcacttccctggcagtagaaagaaatgtaggttagtgcagggaggtcactggctttggagatggtggcagggtggagcagtctctaatgtgaatggaagtgcacatgccctctggacctgcagcaatgctggcttcagaggggccttctctggtacctttccaattttccccaaccaggtagaagagccactgcccagtgtcttgggctcaactgaaaccccctgtacaagaaagagacccccctttccactgtgtctctctcctcctccccactcactgtctctctgtctccctcactccgtgtctctctcctctcttctgtgtctctctgcctctccctctctctgtttctctctgtatcgctcttttttttcaatctctgtctctatctctcctcctttctctttatctctctgtctctccctctgtctttctctctgtgtgtgtttttttttctgtctttctgcatctctgtttctgtctccttctctcggttctgtatctttgtccccctctctccctatctctgtttctctgtctcagtccctttctgtctttatgtctctgtttatctctctcagtctctgtatctctgtctctttctctttttatcctttctctgtctctttgttctctatccctccatctctctctccctctccctcagtctctctctgtctcttcctttctctgtctcagcctctctctgtctctgtatctctatctctttctctctctcccagtctctctctttctatctctctctctctctctctctctggcactcactcacccacttacttgaagtctccatgagcagtgggtggcttcacctttctgtttcgccactttgcagtccgacccgtggggcttgcagaccctcttctggcgcacaccttcaggagaccaacggtgccagggcactcccgtgttcttcagggttccagccccgagtagttggtaaacatcagtaatcgtcctagagatccactgtagattcctcatccaggtactgaatgaggcccttctgagcaaatttaatggaatgaccttggtgacattacaagatgacggctcatctcctgtagtctattattgttgggcatttaggttgatactatgtcttcactattgtgagtagtgctgcagtgaacatatatgtgcatatgtgtctttatgaaagaatgatttatagtcctttgggtatatacccagtaatgggattgctgggttgagtggtatttctatttttaggtctttgaggaattgcttaggtctttgaggaatcgcatttgcgttttcaaacatcatggagaacacaggtcttgaggatgtgcaggaacatggagaccaaggaatgaaaaagccatcaggttggaagtgaagtcacccagagtgattgcaggtttatggacagaaaggaaaatgctctgattcctggtgtccatgaggaaggtggatgccaatagatggtgctacacagacacttgtgaaaggaagaagggaaagagtctgcctccatgggctgagtagggctgctggggcctcaggcttcacacatagtgtcagacatgctgtgttggtcaggttcatctgggacccctgtgcctcccccaggaaaccctattggtaggtgtgggcaggcttccctccatgtgtccttaaatacactgactgctctgtgtgtgactgtggatgagcagcgtagggctggtcatctggagggctgggcttggttccagctcttgtactgatggattgattggttttgggcaagtcacttccccccataacctttccattgtaccacaatcctaatagagttggatgccagtttctggcaccctgggcttcacagggacacagagaaacagagaggaccagaaaattaggctgataataatcatttcttctctatttggtctggagaagaaatgacttagggttggcacaggttaatatgtcaactagaaagaacctttgaaaatctttagttcaagaattctaaacctaaaatctgtgggacactaggatgatttttatggactctttgaatcaccctgaaattttttaaaatattttttctttatgggcacatgtgtggttttttagcagaaggattccttagcattgattacattgtaaaagggccaacaatcataaaacaattaattccccagcatcatgttatgtgattcataactgaggggtctccgcagatggcatttggaaacgtgcgggtcctttttttcagttgtcagcatgactggggtcacgatggatatttagtaggtgggggcctgcgttgcatgcgtgggggattaaacttaacaataaaaaactgtcctgtttgaaatcccagtagcacccctctggagaaacactgctcaggaactgagcccccaagatgcacagtgattctcccgtggccacaaagctcattagtggcagagttggtttttattaacagatcaaaacaggggatgtgccaagaacctacattattttgtttctcatcatcagctgcaaatgtgctgcaatctgtgaaaacaaaagaatcagaaatctgtcccaccttcaacgctccagccatttttaaaaatgagtctttgggttcttggttgttttttaccatcaaatgagaaatgaggaaaggaatattttacatttggagaaactaaaccataaacaattgatcccactagccccatatcacctagatgtgttcttcagctactgtgaattggtgacgcaagccttagactggaaatttcccctttatgtttcagaggatctgtcttgaatgtctcttactctacaaagaaagaaacattaatataccagcatgctgcttgctacctagtttactgcaatgaagtggcaggtgccttagactttggagtgaaattgagagatattccgcagtattagctaagagttaggcctgtgggatcacagagacaggggtttgttccctggctctgtctctcaattgatgtgtcttcttaagaaaaagtacttaatccttctgagcctcagtttccttggctgaaaagtggggataataatcgtatccacaaagattaattgagatcatccatgtgaagtgttccgcacagtctagcatatggggaggctcaataaatgtgagctgttattacaagcgattattatgacttgtgtctgtgattaaagacagcctgaggttcagagtgtttgtgccaaaattgctttcagaggacaagctctgggttggtttttcagtcttgcccagctgcccagagtcactagagtgtttggggctggagtcacagtgtttattaagtgcctaccacacactccagttttgatggaagattggttttcttcctgtgtgcacatccccgcatcactacatgagtgggtgagaagagactcagaaaagcaccagacacatgtttcttctgcctcagttccctagtctgtaaaagtactcaagagcatgatggcggccacagggaacagaggggagagacacctggaggagcaaaagacagtcccagctgtcagtcttcagacaccatggttttctggagaagggatccagaccagaccgccaatcaatatagccgcagaccgccagtcaatatacctcatccttgtgaaaggcggttgtctgtgtggcagcagggagacaggaggggccatatttgacacaagcctgctggccaagtctaaaggagtcagcctgccatctgaccacactttctgcagccaagtcctctgggggccaaatcagtatggtttgagtttatccccgacttgctgctatggttgatgcacacaaaaaaggtttggccattgccaagccagctgtggtcttggtttggaagaggcaaccaaagtaagaattgaagggaaggcatgctttgggatttcccttagccttcaaccctctagaggaagccaacttctttattctgccattttgagactcatgcttgtctgggtggataagataaatactttcatcattatcatcattattattaattataattattgaaaatcaattactcagcagcccctaccttgtaatggtatcacttacagttgtatagcattttgcagacaacgtatacactagaccataaactcagctcgaacataagcataaatttaaaacaaaaacattgacttgggcagctattatctgaggtcaaagttattctttaattccagctgtaccttcagctgcctatgtcgctgaagcaacttccccttgtgtgttttcacacttagagattggagtaatccagacacagaaaatgataccaaaattgaaatgtttctgaacgttaaatgattcaataatttgaaaatagtttcaaatttttcaaaattcaaaaatttgaaaatagttcgactagagcccatcctcacctcaggtagttacgtggtgtgtgtgtgtgtgtgtgtgtgtgtgtgtgtgtgtgtgtaggcacacaaacccatgcatgcacacatgtatgcacagtggtggatgagtgtgagttaccaaaacaaataccactaaatgcaggataacaccatgatggctagtagctggattgactcagattttctctgcagatccttcctagtccaccctccttccatgacatgggagtttgtgatatgcaaaggataaagtaaacctgagtttcctggggcttgtgtcggcataccaagctcctttaagatctctctttgccaagatggggctaagccagaggcttccttggcctggggaataactgtcctaccttcctccctggagcggctggcgcacactgttttgacgtgtgccatgccttccatcttttacggcctcggggccagaggagggtatgctttgaacaatgtgaaattcctctcctaacagctgtgcaaaggaaactcacagctttctatctccatctcggtccacttagctttcttttggggtataggtttcttgtctgttcaggggtccctgttcctcactttctggccttcagaaggaccagtttcagtacttcctttcttagggaggcaagtcagtcttctgaggttctctgttttattttattttatcctagagtatgccttcactgttgaccgtgtcttgcctcatttctgctaagaagccagcatcttctgaaaattgagtgtcttgtcctgtttcagatcttgggccgaggattgaccatgtatgttagtcagtttcagagccctgagttttaagtgctaagttttaaggagaggaacaacagtagaattagatatcttaaagaacaggataggaatccacttccctgccccttctctcacctggtttgacactacatagatacagacctgtcctgagttcagggattgtctaatgaggcctcaccaaataccaacagagagactagctgtttctcctctagctcactgactgcttctagttttccgtgactttagagcatgtgcgtcagcaggttttggggaccatctctggcctgctttctgatcttggctctgtccctcaatttatgtcttttttgtgctccataagacagggagtttcatggttgccactacccgagaggtgtgctaaagtgaatgaggtggaggacacagagctagcagggaagaaggtgccgtggaaacccacacagctttattcatgtgagctcatttctcatttactccttgtagcaatgccaagtcaccccctcccttcatccctttccaagcatttccctcccttgttggttttggatccattgtaaccccagtgagttaacctacatgttttagtttgaatctaatcatgctatttccaggttgccaacccccacgggtgcttcagcctaattggtctgtcctcactggtgtctgcagcaccttccctttgagcgtcatctgtgcattttaattaatctgccactttttcctccctcctgcttccggatcattaataaagagattaaccaaaaccagaccaatccccagcggaggctccaccaggatctctctctcccagctctcagctttgtcatgggtcagaacatcatcatgtggccccattgactaattctgaggcctcaagacctatgttcagagcaaagccagtgtgaattaatttttcaattaagatttggggaacaagcatagccagtcttttatatatggccttagtttaatatttccaccacattcctttcccttttgtaattctactttaaatctatcactttcccacctctctccctttccagtccctgaacaagacattagggttatctggcaggatgtctcctgagcctgtagcattagtcagagatcatgtcatagccgaagaaattctccaaagaatcaggcccttctggacacagctggccagcgtcctctttgaccccagccagagaatgcatttgcctccagagaatatggctacaccagaaataatgaaatctcttgaatttgcatattaaaaatttggcaaattaaaatttgctttcacctctgctctcatgactcctctctgaggaaagctaaaacagagcctttctgctttctttgtaagtcacccagatttccagcgctggtctcaaacccaggatgtgagatggtgcactccgtgttctgtccactacaacacagggcctctgcaggcacaggtgacctgcagatgggctgcactggagagcatcaggcccaggagggactagggtgagggaattggattgtgtttacttttgtgggggatgctttcatagggaatacagggaggaggacacaggattgatggcctcaaatctctgcaaactctgcttagagctgaggcttcttggggaaggacacagcctgctgacagcagccgtcctggctccaggcttggagcttgggcttcccctggaagtaaactctctagaatgtttgagagcaaggacagacggagaggcagccgagtgtcatcattaataacatgagctctagagccagaaggtgcaaatcctgactctgttgcttgttagctggttgtggaacccctctttgccttggtttccccattcaaaatgggaaatataatagtacgtacttcaggatggttgttactaggatttaagatttatgtaagccagtacctggcactttgcatttttattcttggtgatctcacccctaagcagtctaaaaatttacttcacacatgtgcagcaagaggcgtctttaggtacacggtcaggaggtgctcctgtgtagggaagctggtcctggagaggtgaattggaacctgaaggctgcagcccagtctctgcacgtgacagggcagacgcaggttgctgggggctcagattctgtgccactgtctacctcagcttccttttccatgtcagctgcttcttgaatacccccaaaccctctgtggatgctgtaaactgagccaaaaaggaggaatcagaaattgctctcttttgagtattttgagggatggtgaaaccttgtaggaatgttgctccagggactgagaaaacaccatatgtgggaaagcgtttctaagtgaggaaaatcgcacatgcacgtcggtcaggatcttggaaaactctgagcaggggaaatgggcactggggagagtgtagaaagggggttcactaaggtctttaacaggtctttttctaattatagccaagaagagcctggggaccatggccgacttcagagccagggcctgtattttctttgggaaaagaaggcagagttgattggcttccaaaaccaggcttggcaaaagcccatgcaggctctccagccagtaagcagtgcctggggtaggtctcgatcgtagcaggcgctcattcagtaaatagacgtcgaaagtccgcagcgtgtccagccctatgctgggagtcaaggatgtgtggatggaaaggacatggtccctgtcgtcaaagagaaggcacaccaacaataatagcacaatatgacaattgcttaaatgaagctctctgcagatgacagggacccctagagaaagagcgtagacattcccctaaatagcagaactcgctgctgtgccttgcctggatggagctggcactgccttcctgtttccattccccactccagggaactggcccactgggggactcccaccccggacatggagtgagaaatgaaggtattggtggccaaaaagtgaccagagatcagaatgcatctattcttgcccccagcaaattcagaaacaccacctctcccttgcccgtgtttgctttcgtcatttgtctgttctctgggcttcgagttcataatattcctatcttctcccacaaccagtgtaactggtctgagatccaagcagtcgggcaccatggcatctgggggaaagccttgtggggaccgtgttggtaaagattgctgtgagccagatgtagaggagggagctctccagactctgggtccctcgcccgtgtgcgtcaagggcaggtgtgcaccatctcccgtggccacaggccattcagcttcatgttctctaacatttctagtgtgctcactctgtacctgatgctatgctaggtgcttccatgtggatttcattgtttacccctcacgataactttcatggtgcacaagccatgtgatttttgttgcgcctacgaaccaaatgcccccgtcactctctgccattgtttagcagtctgaccttagacagctcacttcaccacaactgcaggcctccgttcccttatatgtataaatgaggaggttgtctagggtcctttccagctgcaaacctctgtgttttggggagttctgttagcaacattcttggacttgctctctacgagaaaagctagaagtcgattattaaaatggagtccacaggaagcctgcagggctttaagacagccttctaaagagtttagaaacactcaccagcctgcagatgacttactcccactacttattacaaagtatcatggcaagtaagaaagaaatggtcagccactgggagagcaggctgaggttgcaaggaagtggcaggtgctatcgttgggatcttgggggagcattgtagaaaggtcagctttggaaccaggcactgaaaaacgggtgaaatttcaacaggagaggcagtgcacatgggttgtgatttgagcagcagtgagtagtgaatggggttggagcaagaggcctgtgagcccagtcatcacatggaaaagggaggtgagggccagagtgcagagaacccctctcactttcctgtgggtctctcctcttctttttttttttttttttttttgaattggagtcttgctctgtcgcccaggctggagtgcagtggcgtgatgttggctcactgtaagctccgcctcccgggttcacaccattctcctgcctcagcctcccgagtagctgggactacaggctgccaccgtgccctgctaatttttgtatttttttttagacggggtttcaccttgttagccaggatggtctcgatctcctgacctcgtgatccacccacctcggcctcccaaagtgctgggattacaggcataagccaccgtacccggcctttctcctcttctttaaactgcatttaggttgtcctcatctataagatgaaggaataagattagatggcctctttatatggcttatctacttctaataaactttggttccatattccagccaccacccataaagactcttactttttcctcctcaatccatcagcatcagccagcattctccctctcagttcatcctggtcattacctcactaatctgtaccttgactcttattctacctgggacctcccctcactaaccatacttgatttatttccttaagagcggatatcctgtgtattcttagcttacagtggctgagcttttgggaggtttaacaaattgtttttcaatagactctcagtcctaaatgattttattgcagctgtattattctttttgaggggagtagagaatgtaatcctagttgtatgccatattttttgtattgttcaagttgcattttgttgggcctgtaatattgaagaaaatgtcacttgtatgcagaataggagggagattccttatgctgtagaggaaccattttcctaggatagtacaattccttagagtcatctctaagggtgagcagcaaagctagaatccctctcttggctttgaccttgaaggagtcagttttcccaaagactagttcccatggaaagaagatggtctccttatcacagcagcaagaggaggcagtatgagcagagtgcctcactgttgttgacctctagggacaagtgagccggcagtatttcagacaagctgggaaagaggctgtctgtgagtcctgggagcgagtgagcactggcaggctcagacataggtgctggttagcaggactgcttttctgtttcttgtgtcggctttgtttatttcctctctattttccccctggacttagtaaagtctttccgaaaataccaaaggtgaaccaggggaagagtttttattttccatgtttggacagaactttaaagaggaaatgatgtacccccctgggagccagtgaggtggcagcgatggtgattaaggagtgaatatctcaaggaggtggacgaattcggggatcactagctcagctgcccctctccacctggagcatctccttccagtgctaccctcagaacatctgggctttgctctagtgagggagagactagcaatgaaggtgtcttgagatcagcactgtaattccaccaggacgccaccggagtccggtgttaagcttctactatggcaacagaatgagagcgtggatgggttgaaatgccatttcaacaaggaaatagtagaattagaagaagcataagcactaaaaggaacattttgtagcagaaatgttaaaaatctaaaggaggcaagtgaatcaacaatgactcttctattctgggcaagtccagcccatttatgtaaggtggttattctgcatctctgtcttctgcaagtagtgctgtggcagagctgcgttttgtggagagcgtccccggggatggagcagatcagttggtgatgcgtatgtatcagaaagctcggcagagcaccctggaacgtaggccctctcgcggagtgggtagtggccctacatgttcatttccaagggcaggagaatagaccgttccagctgcggcctggccagggatgaccccacatctgacactgcaatatgggggcaactgaaccagtcctcagcctcagtgtgttccaggggctgcagctggggagcagtcgaactctttcttgagacaattacaaggccaccgctgctgctgctgaagggaagttactccatgtttacaattctcaggtttgaagttttcatgctttgccaaggtagagtgaaccatgcgtctttgcaggctcaagggatgtttaaagaagcggtaggacatcgtccacccacaagcagagaccgcaggataaagcagacatccaatgtaaatacaacccgtgcaaaaagcagagtcggcagacctggagtgcattcgcagtatctcccgggggtgggggaaagaaatcacctcttcagaatgtccagaggggagttgccttgcttacctggggggcggtaccctctctcgtgccctcacagggctactcagcctcaggtagctggtgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatca
